(12) United States Patent
Wohlgemuth et al.

(10) Patent No.: US 7,691,569 B2
(45) Date of Patent: Apr. 6, 2010

(54) METHODS AND COMPOSITIONS FOR DIAGNOSING AND MONITORING TRANSPLANT REJECTION

(75) Inventors: Jay Wohlgemuth, Menlo Park, CA (US); Kirk Fry, Palo Alto, CA (US); Robert Woodward, Pleasanton, CA (US); Ngoc Ly, San Bruno, CA (US); James Prentice, Austin, TX (US); MacDonald Morris, Atherton, CA (US); Steven Rosenberg, Oakland, CA (US)

(73) Assignee: XDx, Inc., Brisbane, CA (US)

( * ) Notice: Subject to any disclaimer, the term of this patent is extended or adjusted under 35 U.S.C. 154(b) by 700 days.

(21) Appl. No.: 10/511,937

(22) PCT Filed: Apr. 24, 2003

(86) PCT No.: PCT/US03/12946

§ 371 (c)(1),
(2), (4) Date: Jul. 22, 2005

(87) PCT Pub. No.: WO2004/042346

PCT Pub. Date: May 21, 2004

(65) Prior Publication Data

US 2006/0088836 A1 Apr. 27, 2006

(51) Int. Cl.
C12Q 1/68 (2006.01)
(52) U.S. Cl. ......................................................... 435/6
(58) Field of Classification Search ........................ None
See application file for complete search history.

(56) References Cited

U.S. PATENT DOCUMENTS

| | | | |
|---|---|---|---|
| 4,190,535 A | 2/1980 | Luderer et al. | |
| 4,215,051 A | 7/1980 | Schroeder et al. | |
| 4,350,593 A | 9/1982 | Kessler | |
| 4,358,535 A | 11/1982 | Falkow et al. | |
| 4,376,110 A | 3/1983 | David | |
| 4,582,789 A | 4/1986 | Sheldon, III et al. | |
| 4,683,195 A | 7/1987 | Mullis et al. | |
| 4,683,202 A | 7/1987 | Mullis | |
| 4,751,001 A | 6/1988 | Saunders | |
| 4,762,780 A | 8/1988 | Spector et al. | |
| 4,789,630 A | 12/1988 | Bloch et al. | |
| 4,800,159 A | 1/1989 | Mullis et al. | |
| 4,818,418 A | 4/1989 | Saunders | |
| 4,843,155 A | 6/1989 | Chomczynski | |
| 4,889,818 A | 12/1989 | Gelfand et al. | |
| 4,908,318 A | 3/1990 | Lerner | |
| 4,946,778 A | 8/1990 | Ladner | |
| 4,946,952 A | 8/1990 | Kiefer | |
| 4,965,188 A | 10/1990 | Mullis et al. | |
| 5,053,134 A | 10/1991 | Luderer et al. | |
| 5,063,162 A | 11/1991 | Kiefer | |
| 5,066,584 A | 11/1991 | Gyllensten et al. | |
| 5,075,216 A | 12/1991 | Innis et al. | |
| 5,079,352 A | 1/1992 | Gelfand et al. | |
| 5,091,310 A | 2/1992 | Innis | |
| 5,120,525 A | 6/1992 | Goldenberg | |
| 5,142,033 A | 8/1992 | Innis | |
| 5,143,854 A | 9/1992 | Pirrung et al. | |
| 5,210,015 A | 5/1993 | Gelfand et al. | |
| 5,212,071 A | 5/1993 | Fearon et al. | |
| 5,215,882 A | 6/1993 | Bahl et al. | |
| 5,219,727 A | 6/1993 | Wang et al. | |
| 5,264,351 A | 11/1993 | Harley | |
| 5,278,043 A | 1/1994 | Bannwarth et al. | |
| 5,310,652 A | 5/1994 | Gelfand et al. | |
| 5,314,809 A | 5/1994 | Erlich et al. | |
| 5,322,770 A | 6/1994 | Gelfand | |
| 5,340,720 A | 8/1994 | Stetler | |
| 5,346,994 A | 9/1994 | Chomczynski | |
| 5,352,600 A | 10/1994 | Gelfand et al. | |
| 5,374,553 A | 12/1994 | Gelfand et al. | |
| 5,385,824 A | 1/1995 | Hoet et al. | |
| 5,389,512 A | 2/1995 | Sninsky et al. | |
| 5,393,672 A | 2/1995 | Van Ness et al. | |
| 5,405,774 A | 4/1995 | Abramson et al. | |
| 5,407,800 A | 4/1995 | Gelfand et al. | |
| 5,411,876 A | 5/1995 | Bloch et al. | |
| 5,418,149 A | 5/1995 | Gelfand et al. | |
| 5,420,029 A | 5/1995 | Gelfand et al. | |
| 5,426,039 A | 6/1995 | Wallace et al. | |
| 5,445,940 A * | 8/1995 | Brenner et al. | 435/7.24 |
| 5,455,170 A * | 10/1995 | Abramson et al. | 435/252.3 |
| 5,459,037 A | 10/1995 | Sutcliffe et al. | |
| 5,466,591 A | 11/1995 | Abramson et al. | |
| 5,468,613 A | 11/1995 | Erlich et al. | |
| 5,476,774 A | 12/1995 | Wang et al. | |
| 5,487,970 A | 1/1996 | Rowley et al. | |

(Continued)

FOREIGN PATENT DOCUMENTS

EP 0 217 102 A2 4/1987

(Continued)

OTHER PUBLICATIONS

Dietz, A. B. et al. (2000). "Maturation of Human Monocyte-Derived Dendritic Cells Studied by Microarray Hybridization," *Biochemical and Biophysical Research Communications* 275:731-738.

(Continued)

*Primary Examiner*—James Martinell
(74) *Attorney, Agent, or Firm*—Morrison & Foerster LLP

(57) ABSTRACT

Methods of diagnosing or monitoring transplant rejection, particularly cardiac transplant rejection, in a patient by detecting the expression level of one or more genes in a patient, are described. Diagnostic oligonucleotides for diagnosing or monitoring transplant rejection, particularly cardiac transplant rejection and kits or systems containing the same are also described.

7 Claims, 15 Drawing Sheets

U.S. PATENT DOCUMENTS

| | | | |
|---|---|---|---|
| 5,487,972 A | 1/1996 | Gelfand et al. |
| 5,491,063 A | 2/1996 | Fisher et al. |
| 5,491,086 A | 2/1996 | Gelfand et al. |
| 5,501,963 A | 3/1996 | Burckhardt |
| 5,506,145 A | 4/1996 | Bull et al. |
| 5,512,462 A | 4/1996 | Cheng |
| 5,514,556 A | 5/1996 | Shearer et al. |
| 5,538,848 A | 7/1996 | Livak et al. |
| 5,561,058 A | 10/1996 | Gelfand et al. |
| 5,565,339 A | 10/1996 | Bloch et al. |
| 5,569,583 A | 10/1996 | Greenberg et al. |
| 5,571,673 A | 11/1996 | Picone |
| 5,573,906 A | 11/1996 | Bannworth et al. |
| 5,604,099 A | 2/1997 | Erlich et al. |
| 5,618,703 A | 4/1997 | Gelfand et al. |
| 5,618,711 A | 4/1997 | Gelfand et al. |
| 5,624,833 A | 4/1997 | Gelfand et al. |
| 5,635,365 A | 6/1997 | Ansari et al. |
| 5,641,864 A | 6/1997 | Gelfand |
| 5,658,744 A | 8/1997 | Ochoa et al. |
| 5,665,551 A | 9/1997 | Gelfand et al. |
| 5,674,738 A | 10/1997 | Abramson et al. |
| 5,677,152 A | 10/1997 | Birch et al. |
| 5,693,517 A | 12/1997 | Gelfand et al. |
| 5,707,807 A | 1/1998 | Kato |
| 5,716,787 A | 2/1998 | Dunn et al. |
| 5,721,351 A | 2/1998 | Levinson |
| 5,728,822 A | 3/1998 | Macfarlane |
| 5,766,585 A | 6/1998 | Evans et al. |
| 5,773,258 A | 6/1998 | Birch et al. |
| 5,789,224 A | 8/1998 | Gelfand et al. |
| 5,795,762 A | 8/1998 | Abramson et al. |
| 5,804,375 A | 9/1998 | Gelfand et al. |
| 5,807,522 A | 9/1998 | Brown et al. |
| 5,811,284 A | 9/1998 | Chang et al. |
| 5,837,832 A | 11/1998 | Chee et al. |
| 5,939,270 A | 8/1999 | Haunsø et al. |
| 5,939,292 A | 8/1999 | Gelfand et al. |
| 5,958,342 A | 9/1999 | Gamble et al. |
| 5,958,688 A | 9/1999 | Eberwine et al. |
| 5,965,366 A | 10/1999 | Ochoa et al. |
| 5,968,799 A | 10/1999 | Gelfand et al. |
| 5,973,137 A | 10/1999 | Heath |
| 5,981,481 A | 11/1999 | Fearon et al. |
| 5,994,056 A | 11/1999 | Higuchi |
| 5,994,076 A | 11/1999 | Chenchik et al. |
| 6,001,611 A | 12/1999 | Will |
| 6,004,755 A | 12/1999 | Wang |
| 6,010,853 A | 1/2000 | Kanteti et al. |
| 6,020,186 A | 2/2000 | Henco et al. |
| 6,033,860 A | 3/2000 | Lockhart et al. |
| 6,040,138 A | 3/2000 | Lockhart et al. |
| 6,040,166 A | 3/2000 | Erlich et al. |
| 6,045,996 A | 4/2000 | Cronin et al. |
| 6,048,695 A | 4/2000 | Bradley et al. |
| 6,048,709 A | 4/2000 | Falb |
| 6,060,240 A | 5/2000 | Kamb et al. |
| 6,066,322 A | 5/2000 | Levinson |
| 6,066,498 A | 5/2000 | Levinson |
| 6,084,083 A | 7/2000 | Levinson |
| 6,087,112 A | 7/2000 | Dale |
| 6,087,477 A | 7/2000 | Falb et al. |
| 6,090,556 A | 7/2000 | Kato |
| 6,099,823 A | 8/2000 | Falb |
| 6,124,433 A | 9/2000 | Falb et al. |
| 6,127,155 A | 10/2000 | Gelfand et al. |
| 6,132,997 A | 10/2000 | Shannon |
| 6,146,828 A | 11/2000 | Lapidus et al. |
| 6,150,121 A | 11/2000 | Hamawy et al. |
| 6,156,887 A | 12/2000 | Levinson |
| 6,162,604 A | 12/2000 | Jacob |
| 6,168,933 B1 | 1/2001 | Kaser et al. |
| 6,171,785 B1 | 1/2001 | Higuchi |
| 6,177,254 B1 | 1/2001 | Rattner et al. |
| 6,187,534 B1 | 2/2001 | Strom et al. |
| 6,190,857 B1 | 2/2001 | Ralph et al. |
| 6,190,872 B1 | 2/2001 | Slotman |
| 6,194,158 B1 | 2/2001 | Kroes et al. |
| 6,197,563 B1 | 3/2001 | Erlich et al. |
| 6,203,987 B1 | 3/2001 | Friend et al. |
| 6,204,371 B1 | 3/2001 | Levinson |
| 6,214,979 B1 | 4/2001 | Gelfand et al. |
| 6,218,122 B1 | 4/2001 | Friend et al. |
| 6,222,093 B1 | 4/2001 | Marton et al. |
| 6,225,084 B1 | 5/2001 | Falb et al. |
| 6,225,093 B1 | 5/2001 | Grant et al. |
| 6,228,628 B1 | 5/2001 | Gelfand et al. |
| 6,242,185 B1 | 6/2001 | Kaser et al. |
| 6,245,334 B1 | 6/2001 | Seilhammer et al. |
| 6,245,526 B1 | 6/2001 | Yue et al. |
| 6,245,527 B1 | 6/2001 | Busfield et al. |
| 6,248,527 B1 | 6/2001 | Chen et al. |
| 6,248,528 B1 | 6/2001 | Chen et al. |
| 6,251,597 B1 | 6/2001 | Shyjan |
| 6,262,244 B1 | 7/2001 | Houchins et al. |
| 6,274,312 B1 | 8/2001 | Gish et al. |
| 6,280,941 B1 | 8/2001 | Tsao et al. |
| 6,303,321 B1 | 10/2001 | Tracey et al. |
| 6,306,602 B1 | 10/2001 | Sillekens et al. |
| 6,365,352 B1 | 4/2002 | Yerramilli et al. |
| 6,403,304 B1 | 6/2002 | Stashenko et al. |
| 6,410,319 B1 | 6/2002 | Raubitschek et al. |
| 6,811,973 B1 | 11/2004 | Reich |
| 6,905,827 B2 | 6/2005 | Wohlgemuth et al. |
| 6,964,850 B2 | 11/2005 | Bevilacqua et al. |
| 7,026,121 B1 | 4/2006 | Wohlgemuth et al. |
| 7,235,358 B2 | 6/2007 | Wohlgemuth et al. |
| 7,514,209 B2 | 4/2009 | Dai et al. |
| 2001/0021700 A1* | 9/2001 | Moore et al. .............. 514/44 |
| 2002/0042386 A1 | 4/2002 | Rosen et al. |
| 2002/0128436 A1 | 9/2002 | Strom et al. |
| 2002/0132235 A1 | 9/2002 | Avihingsanon et al. |
| 2003/0139466 A1 | 7/2003 | Peritt et al. |
| 2004/0033498 A1 | 2/2004 | Behrens et al. |
| 2004/0072181 A1 | 4/2004 | Whitehead et al. |
| 2005/0281815 A1 | 12/2005 | Eshel et al. |
| 2006/0051803 A1 | 3/2006 | Wohlgemuth et al. |
| 2006/0216707 A1 | 9/2006 | Stuhlmuller et al. |
| 2006/0263813 A1 | 11/2006 | Rosenberg et al. |
| 2007/0037144 A1 | 2/2007 | Wohlgemuth et al. |
| 2007/0037166 A1 | 2/2007 | Wohlgemuth et al. |
| 2007/0037167 A1 | 2/2007 | Wohlgemuth et al. |
| 2007/0248978 A1 | 10/2007 | Lal et al. |
| 2008/0038746 A1 | 2/2008 | Rosenberg et al. |

FOREIGN PATENT DOCUMENTS

| | | |
|---|---|---|
| EP | 0 217 992 A2 | 4/1987 |
| EP | 1 077 254 A2 | 2/2001 |
| EP | 1 162 276 A2 | 12/2001 |
| WO | WO 91/18626 | 12/1991 |
| WO | WO-94/23023 A1 | 10/1994 |
| WO | WO 95/17506 | 6/1995 |
| WO | WO 96/39536 | 12/1996 |
| WO | WO-97/16568 A1 | 5/1997 |
| WO | WO 97/30065 | 8/1997 |
| WO | WO 98/24935 | 6/1998 |
| WO | WO 99/10536 | 3/1999 |
| WO | WO 99/11782 | 3/1999 |
| WO | WO 99/15700 | 4/1999 |
| WO | WO 99/52541 | 10/1999 |
| WO | WO 99/57130 | 11/1999 |
| WO | WO 00/04191 | 1/2000 |
| WO | WO-00/04191 | 1/2000 |

| | | |
|---|---|---|
| WO | WO 00/12753 | 3/2000 |
| WO | WO-00/12753 | 3/2000 |
| WO | WO 00/23573 | 4/2000 |
| WO | WO-00/23573 A3 | 4/2000 |
| WO | WO-00/29574 | 5/2000 |
| WO | WO-00/46372 | 8/2000 |
| WO | WO 00/46372 | 8/2000 |
| WO | WO-00/52209 | 9/2000 |
| WO | WO 00/52209 | 9/2000 |
| WO | WO 00/55375 | 9/2000 |
| WO | WO-00/55375 | 9/2000 |
| WO | WO-00/58473 A2 | 10/2000 |
| WO | WO-00/63372 | 10/2000 |
| WO | WO 00/63372 | 10/2000 |
| WO | WO 00/73498 | 12/2000 |
| WO | WO-00/73498 A1 | 12/2000 |
| WO | WO 00/78808 | 12/2000 |
| WO | WO-00/78808 A1 | 12/2000 |
| WO | WO-01/20004 | 3/2001 |
| WO | WO 01/20004 | 3/2001 |
| WO | WO 01/23426 | 4/2001 |
| WO | WO-01/23426 | 4/2001 |
| WO | WO 01/23564 | 4/2001 |
| WO | WO-01/23564 | 4/2001 |
| WO | WO 01/25473 | 4/2001 |
| WO | WO 01/29269 | 4/2001 |
| WO | WO 01/32927 | 5/2001 |
| WO | WO 01/40302 A2 | 6/2001 |
| WO | WO 01/47944 A2 | 7/2001 |
| WO | WO 01/54733 A1 | 8/2001 |
| WO | WO 01/55164 A1 | 8/2001 |
| WO | WO 01/55201 A1 | 8/2001 |
| WO | WO 01/55203 A1 | 8/2001 |
| WO | WO 01/55205 A1 | 8/2001 |
| WO | WO 01/55328 A2 | 8/2001 |
| WO | WO 01/55368 A1 | 8/2001 |
| WO | WO-01/57182 A2 | 8/2001 |
| WO | WO 01/60860 A3 | 8/2001 |
| WO | WO 01/71005 A2 | 9/2001 |
| WO | WO 01/81916 A2 | 11/2001 |
| WO | WO 01/86003 A2 | 11/2001 |
| WO | WO 02/00677 A1 | 1/2002 |
| WO | WO 02/00928 A2 | 1/2002 |
| WO | WO 02/28999 A2 | 4/2002 |
| WO | WO02/057414 A2 | 7/2002 |
| WO | WO-02/057414 A2 | 7/2002 |
| WO | WO-03190694 A2 | 11/2003 |
| WO | WO-2004/042346 A2 | 5/2004 |
| WO | WO-2004/108899 A2 | 12/2004 |

OTHER PUBLICATIONS

EMBL-EBI Accession No. AA053887, last updated Aug. 31, 2006, located at <http://www.ebi.acu.uk/cgi-bin/dbfetch?db=embl&id=AA053887&style=raw> visited on Oct. 31, 2007, 2 pages.
EMBL-EBI Accession No. AAC77576, located at <http://www.ebi.ac.uk/cgi-bin/dbfetch?db=emblcds&id=AAC77576&style=raw> visited on Oct. 31, 2007. (1 page).
EMBL-EBI Accession No. AAK80490, located at <http://www.ebi.ac.uk/cgi-bin/dbfetch?db=emblcds&id=AAK80490&style=raw> visited on Oct. 31, 2007. (1 page).
EMBL-EBI Accession No. AI775145, last updated Jun. 21, 2002, located at <http://www.ebi.ac.uk/cgi-bin/dbfetch?db=embl&id=AI755145&style=raw> visited on Oct. 31, 2007. (2 pages).
EMBL-EBI Accession No. AK000354, last updated Sep. 12, 2006, located at <http://www.ebi.ac.uk/cgi-bin/dbfetch?db=embl&id=AK000354&style=raw> visited on Oct. 31, 2007. (3 pages).
EMBL-EBI Accession No. AV742425, last updated Oct. 10, 2000, located at <http://www.ebi.ac.uk/cgi-bin/dbfetch?db=embl&id=AV742425&style=raw> visited on Oct. 31, 2007. (2 pages).
EMBL-EBI Accession No. AW969353, last updated Jun. 8, 2000, located at <http://www.ebi.ac.uk/cgi-bin/dbfetch?db=embl&id=AW969353&style=raw> visited on Oct. 31, 2007. (1 page).

EMBL-EBI Accession No. G06338, last updated Mar. 4, 2000, located at <http://www.ebi.ac.uk/cgi-bin/dbfetch?db=embl&id=G06338&style=raw> visited on Oct. 31, 2007. (2 pages).
EMBL-EBI Accession No. L26474, last updated Jan. 9, 2007, located at <http://www.ebi.ac.uk/cgi-bin/dbfetch?db=embl&id=L26474&style=raw> visited on Oct. 31, 2007. (6 pages).
EMBL-EBI Accession No. M23068, last updated Nov. 14, 2006, located at <http://www.ebi.ac.uk/cgi-bin/dbfetch?db=embl&id=M23068&style=raw> visited on Oct. 31, 2007. (2 pages).
EMBL-EBI Accession No. V00497, last updated Nov. 20, 2004, located at <http://www.ebi.ac.uk/cgi-bin/dbfetch?db=embl&id=V00497&style=raw> visited on Oct. 31, 2007. (5 pages).
Finger, L. R. et al. (1997). "The Human PD-1 Gene: Complete cDNA, Genomic Organization, and Developmentally Regulated Expression in B cell Progenitors," *Gene* 197:177-187.
Fullerton, S. M. et al. (Mar. 1994). "Molecular and Population Genetic Analysis of Allelic Sequence Diversity at the Human Beta-Globin Locus," *Proceedings of the National Academy of Sciences* 91:1805-1809.
Gorcynski, R. M. (1996). "Correlation of Peripheral Blood Lymphocyte and Intragraft Cytokine mRNA Expression with Rejection in Orthotopic Liver Transplantation," *Surgery* 120(3):496-502.
Griffiths, G. M. et al. (1991). "Granzyme A and Perforin as Markers for Rejection in Cardiac Transplantation," *European Journal of Immunology* 21:687-692.
Jardi, M. et al. (1994). "Urokinase Receptor (UPAR) Expression During Hematopoietic Maturation," Journal of Drug Targeting 8(Suppl 1):51.
Joulin, V. et al. (Oct. 25, 1988). "Isolation and Characterization of the Human 2,3-Bisphosphoglycerate Mutase Gene," *The Journal of Biological Chemistry* 263(30):15785-15790.
Krause, S. W. (1998). "Carboxypeptidase M as a Marker of Macrophage Maturation," *Immunological Reviews* 161:119-127.
Le Naour, F. et al. (May 25, 2001). "Profiling Changes in Gene Expression during Differentiation and Maturation of Monocyte-Derived Dendritic Cells Using Both Oligonucleotide Microarrays and Proteomics," *The Journal of Biological Chemistry* 276(21):17920-17931.
Supplementary European Search Report mailed Oct. 18, 2007, for EP Application No. 03799755.8 filed Apr. 24, 2003, 17 pages.
Tamayo, P. et al. (Mar. 1999). "Interpreting Patterns of Gene Expression with Self-Organizing Maps: Methods and Application to Hematopoietic Differentiation," *Proceedings of the National Academy of Sciences* 96:2907-2912.
Willems, R. et al. (May 29, 1998). "Decrease in Nucleoside Diphosphate Kinase (NDPK/nm23) Expression During Hematopoietic Maturation," *The Journal of Biological Chemistry* 273(22):13663-13668.
Australian Search Report mailed Oct. 7, 2005, for Singapore patent application No. SG 200406287-3, filed Apr. 24, 2003, 2 pages.
Bakke, Antony C. et al., (2001) "Neutrophil CD64 expression Distinguishing acute inflammatory autoimmune disease from systemic infections," Clinical and Applied Immunology Reviews, 1: 267-275.
Deuel, Thomas F. et al., (Jun. 1977) "Amino acid sequence of human platelet factor 4," Proc. Natl. Acad. Sci. USA, 74(6): 2256-2258.
Deuel, Thomas F. et al., (Jul. 1981) "Platelet factor 4 is chemotactic for neutrophils and monocytes," Proc. Natl. Acad. Sci. USA, 78(7): 4584-4587.
Dudek, Arkadiusz Z. et al., (Jun. 15, 2003) "Platelet factor 4 promotes adhesion of hematopoietic progenitor cells and binds IL-8: novel mechanisms for modulation of hematopoiesis," Blood, 101(12): 4687-4694.
Golden-Mason, Lucy et al., (Jun. 2000) "Differential Expression of Lymphoid and Myeloid Markers on Differentiating Hematopoietic Stem Cells in Normal and Tumor-Bearing Adult Human Liver," Hepatology, 31(6): 1251-1256.
Morris, Dale L. et al., (Feb. 1997) "Immunophenotyping Analysis of Peripheral Blood, Splenic, and Thymic Lymphocytes in Male and Female Rats," Journal of Pharmacological and Toxicological Methods,37: 37-46.
Shin, Young Kee et al., (Apr. 2001) "Expression of Leukemia-Associated antigen, JL1, in Bone Marrow and Thymus," American Journal of Pathology, 158(4): 1473-1480.

Stellrecht, Christine M. et al., (1991) "Expression pattern of a hematopoietic proteoglycan core protein gene during human hematopoiesis," *Differentiation*, 48: 127-135.
Weast, Ed. (1968). Handbook of Chemistry and Physics, 49$^{th}$ Ed., The Chemical Rubber Co.: Cleveland Ohio, p. A-245.
International Search Report mailed on Sep. 30, 2004, for PCT patent application No. PCT/US03/13015, 4 pages.
Abdallah, A. N. et al. (1997) "Evaluation of plasma levels of tumour necrosis factor alpha and interleukin-6 as rejection markers in a cohort of 142 heart-grafted patients followed by endomyocardial biopsy" *European Heart Journal* 18: 1024-1029.
Ajjan, R. A. et al. (1996) "Intrathyroidal cytokine gene expression in Hashimoto's thyroiditis" *Clin. Exp. Immunol.* 105: 523-528.
Akalin, Enver et al. (2001) "Gene Expression Analysis in Human Renal Allograft Biopsy Samples Using High-Density Oligoarray Technology" *Transplantation* 72 (5): 948-953.
Alizadeh, A. A. et al. (2000) "Distinct types of diffuse large B-cell lymphoma identified by gene expression profiling" *Nature* 403: 503-11.
Alizadeh, A. et al. (1998) "Probing Lymphocyte Biology by Genomic-Scale Gene Expression Analysis" *J Clin. Immun.* 18: 373-379.
Alizadeh, A. et al. (1999)"The Lymphochip: A Specialized cDNA Microarray for the Genomic-scale Analysis of Gene Expression in Normal and Malignant Lymphocytes" *Cold Spring Harbor Symposia on Quantitative Biology* 54, (New York: Cold Spring Harbor Laboratory Press): 71-78.
Alpert, Susan et al. (1995) "The Relationship of Granzyme A and Perforin Expression to Cardiac Allograft Rejection and Dysfunction" *Transplantation* 60 (12): 1478-1485.
Arnett, F. C. et al. (1988)"The American Rheumatism Association 1987 revised criteria for the classification of rheumatoid arthritis" *Arthritis Rheum* 31: 315-24.
Autieri MV, Kelemen S, Thomas BA, Feller ED, Goldman BI, Eisen HJ. (2002) "Allograft inflammatory factor-1 expression correlates with cardiac rejection and development of cardiac allograft vasculopathy" *Circulation* 106(17):2218-23.
Baechler, Emily C. et al. (2003) "Interferon-inducible gene expression signature in peripheral blood cells of patients with severe lupus" *Proc. Natl. Acad. Sci. USA* 100 (5): 2610-2615.
Bave, U. (2000) "The combination of apoptotic U937 cells and lupus IgG is a potent IFN-alpha inducer" *J. Immunol.* 165: 3519-3526.
Bave, U. (2001) "Activation of natural interferon-alpha producing cells by apoptotic U937 cells combined with lupus IgG and its regulation by cytokines" *J Autoimmun.* 17: 71-80.
Bittner, M. et al. (2000) "Molecular classification of cutaneous malignant melanoma by gene expression profiling" *Nature* 406: 536-540.
Bombardier, C. et al. and the Committee on Prognosis Studies in SLE (1992) "Derivation of the SLEDAI, A Disease Activity Index for Lupus Patients" *Arthritis Rheum.* 35: 630-640.
Chang, D. M. et al. (1996) "Cytokines and Cell Surface Markers in Prediction of Cardiac Allograft Rejection" *Immunological Investigations* 25 (1&2): 13-21.
Chebath et al. (1987) "Four Different Forms of Interferon-induced 2', 5'-Oligo(A) Synthetase Identified by Immunoblotting in Human Cells," *J. Biol. Chem.* 262: 3852-2857.
Creemers P, Brink J, Wainwright H, Moore K, Shephard E, Kahn D. (2002) "Evaluation of peripheral blood CD4 and CD8 lymphocyte subsets, CD69 expression and histologic rejection grade as diagnostic markers for the presence of cardiac allograft rejection" *Transpl Immunol.*10(4):285-92.
Damas, J. K. et al. (2001)"Enhanced gene expression of chemokines and their corresponding receptors in mononuclear blood cells in chronic heart failure—modulatory effect of intravenous immunoglobin" *J Am. Coll. Cardiol.* 38: 187-93.
Database Gen Embl, US National Library of Medicine (Bathesda, MD, USA), No. AL 591031, 'Human DNA sequence from clone RP11-151d14 on chromosome 9q13-21.2, complete sequence', Sycamore, N., Oct. 10, 2001.
Davas, E.M. et al. (1999) "Serum IL-6, TNFalpha, p55 srTNFalpha, p75srTNFalpha, srIL-2alpha levels and disease activity in systemic lupus erythematosus" *Clin Rheumatol* 18 (1):17-22.

Deng, Mario C. et al. (1995) "The Relation of Interleukin-6, Tumor Necrosis factor-α, IL-2, and IL-2 Receptor Levels to Cellular Rejection, Allograft Dysfunction, and Clinical Events Early After Cardiac Transplantation" *Transplantation* 60 (10): 1118-1124.
Doi, S. et al. (1994) "Polymerase chain reaction quantification of cytokine messenger RNA expression in peripheral blood monocular cells of patients with acute exacerbations of asthma: effect of glucocorticoid therapy" *Clinical and Experimental Allergy* 24: 854-867.
Dugré, Francine J. (2000) "Cytokine and Cytotoxic Molecule Gene Expression Determined in Peripheral Blood Mononuclear Cells in the Diagnosis of Acute Renal Rejection" *Transplantation* 70 (7): 1074-1080.
Edman, C. F. et al. (1997)"Electric field directed nucleic acid hybridization on microchips" *Nucleic Acids Res.* 25: 4907-14.
Eisen, Michael B. et al. (1998) "Cluster analysis and display of genome-wide expression patterns" *Proc. Natl. Acad. Sci. USA* 95: 14863-14868.
Felson, D. T. et al. (1995) "American College of Rheumatology. Preliminary definition of improvement in rheumatoid arthritis" *Arthritis Rheum.* 38: 727-35.
Fu, Guoliang et al. (2002) "Representational difference analysis in a lupus-prone mouse strain results in the identification of an unstable region of the genome on chromosome 11" *Nucleic Acids Research* 30 (6): 1394-1400.
Gabay C. et al. (1997) "Circulating levels of tumor necrosis factor soluble receptors in systemic lupus erythematosus are significantly higher than in other rheumatic diseases and correlate with disease activity" *J Rheumatol* 24(2): 303-8.
Ghosh et al. (2001) "A Specific Isozyme of 2'-5' Oligoadenylate Synthetase Is a Dual Function Proapoptotic Protein of the Bc1-2 Family," *J. Biol. Chem.* 276(27): 25477-25455.
Golub, T. R. et al. (1999) "Molecular Classification of Cancer: Class Discovery and Class Prediction by Gene Expression Monitoring" *Science* 286: 531-7.
Grant, Simon C. D. et al. (1996) "Serum Cytokines in Human Heart Transplant Recipients" *Transplantation* 62 (4): 480-491.
Gullestad, L. et al. (1999) "Effect of High- Versus Low-Dose Angiotensin Converting Enzyme Inhibition on Cytokine Levels in Chronic Heart Failure" *J. Am. Coll. Cardiol.* 34: 2061-7.
Hastie, T. et al. (2000) "Gene shaving' as a method for identifying distinct sets of genes with similar expression patterns" *Genome Biol.* 1: RESEARCH0003.
Hastie, Trevor et al. (2001) "Supervised harvesting of expression trees" *Genome Biology* 2 (1): http://genomebiology.com/2001/2/1/research/0003 (Apr. 25, 2002): 12 pages.
Heller, R. A. et al. (1997) "Discovery and analysis of inflammatory disease-related genes using cDNA microarrays" *Proc. Natl. Acad. Sci. U.S.A.* 94: 2150-2155.
Hendricks, DA et al. (1995) "Quantitation of HBV DNA in human serum using a branched DNA (bDNA) signal amplification assay" *Am J Clin Pathol* 104 (5): 537-46.
Higuchi et al. (1998), Chemical Abstracts 129: 342625: 7 pages.
Hooks, J.J. (1979) "Immune interferon in the circulation of patients with autoimmune disease" *N. Engl. J. Med.* 301: 5-8.
Hooks, J.J. et al. (1982) "Multiple interferons in the circulation of patients with systemic lupus erythematosus and vasculitis" *Arthritis Rheum.* 25: 396-400.
Hsieh, Hsian-Guey et al. (2001) "IL-17 expression as a possible predictive parameter for subclinical renal allograft rejection" *Tranpl Int* 14: 287-298.
Iida, K. et al. (1982) "Complement receptor (CR1) deficiency in erythrocytes from patients with systemic lupus erythematosus" *J. Exp. Med.* 155: 1427-1438.
Jagota, Arun (2000) *Data Analysis and Classification for Bioinformatics*. Bioinformatics by the Bay Press: 92-93.
Kasprzycka, Monika et al. (2002) "Expression of FasL gene in T cells of renal allograft recipients" *Immunol. Lett.* 80 (1): 9-13.
Katz, Mitchell H (1999) *Multivariable Analysis: a Practical Guide for Clinicians*. Cambridge University Press: 36-42.
Khan, J. et al. (2001) "Classification and diagnostic prediction of cancers using gene expression profiling and artificial neural networks" *Nat. Med.* 7: 673-9.

Kimball, P. et al. (1995) "Cytokine Panel Predicts Early Rejection of Therapeutic Response After Cardiac Transplantation" *Transplantation Proceedings* 27 (1): 1286-1287.

Kobashigawa, J. et al. (1998) "A Randomized Active-Controlled Trial of Mycophenolate Mofetil in Heart Transplant Recipients" *Transplantation* 66 (4): 507-515.

Kumar et al. (2000) "Expansion and Molecular Evolution of the Interferon-Induced 2'-5' Oligoadenylate Synthetase Gene Family," Mol. Biol. Evol. 17: 738-750.

Kumar et al. (1994) "Cell Cycle-dependent Modulation of α-Interferon-inducible Gene Expression and Activation of Signaling Components in Daudi Cells," J. Biol. Chem. 269, No. 41: 25437-25441.

Legros-Maida, Sabine et al. (1994) "Granzyme B and perforin can be used as predictive markers of acute rejection in heart transplantation" *Eur. J. Immunol.* 24: 229-233.

Li, B. et al. (2001) "Noninvasive diagnosis of renal-allograft rejection by measurement of messenger RNA for perforin and granzyme B in urine" N. Engl. J. Med. 344: 947-954.

Liossis, S.N. (2001) "B-cell kinase lyn deficiency in patients with systemic lupus erythematosus" *J Investig Med.* 49 (2): 157-65.

Loftus. B.J. et al. Genome Duplications and Other Features in 12 Mb of DNA sequence from Human Chromosome 16p and 16q Genomics. vol. 60, pp. 295-308 Jul. 1999.

Magnusson, M. et al. (2001) "Importance of CpG dinucleotides in activation of natural IFN-alpha-producing cells by a lupus-related oligodeoxynucleotide" *Scand. J. Immunol.* 54: 543-550.

Marcelin, Anne-Genevieve et al. (2001) "Effects of Cyclosporine and Hydrocortisone on Kaposi's Sarcoma-Associated Herpesvirus Genome Replication and Cell Apoptosis Induction" *Transplantation* 72 (10): 1700-1708.

Melter, Michael et al. (2001) "Expression of the Chemokine Receptor CXCR3 and Its Ligand IP-10 During Human Cardiac Allograft Rejection" *Circulation* 104: 2558-2564.

Mohler, E. R. 3rd et al. "Role of Cytokines in the Mechanism of Action of Amlodipine: The PRAISE Heart Failure Trial" *J. Am. Coll. Cardiol.* 30 (1997): 35-41.

Morita, Ken et al. (2001) "Early Chemokine Cascades in Murine Cardiac Grafts Regulate T Cell Recruitment and Progression of Acute Allograft Rejection" *J. Immunol.* 167: 2979-2984.

Neto, E. D. et al. (2000). "Shotgun Sequencing of the Human Transcriptome with ORF Expressed Sequences Tags." Proceedings of the National Academy of Sciences, 97(7): 3491-3496.

Nickel, Peter et al. (2001) "Cytotoxic Effector Molecule Gene Expression in Acute Renal Allograft Rejection" *Transplantation* 72 (6): 1158-1161.

Oh, Se-Il et al. (2001) "Correlation of Fas and Fas Ligand Expression with Rejection Status of Transplanted Heart in Human" *Transplantation* 71(7): 906-909.

Perou, C. M. et al. (2000) "Molecular portraits of human breast tumours" *Nature* 406: 747-52.

Preble, O.T. (1982) "Systemic lupus erythematosus: presence in human serum of an unusual acid-labile leukocyte interferon" *Science* 216: 429-431.

Pruitt, K. D. et al. (2000) "Introducing RefSeq and LocusLink: curated human genome resources at the NCBI" *Trends Genet.* 16: 44-47.

Raychaudhuri, S. et al. (2001) "Basic microarray analysis: grouping and feature reduction" *Trends Biotechnol.* 19: 189-193.

Rebouillat et al. (1999) "The 100-kDa 2',5'-Oligoadenylate Synthase Catalyzing Preferentially the Synthesis of Dimeric pppA2'p5'A Molecules Is Composed of Three Homologous Domains" J. Biol. Chem. 274 (3): 1557-1565.

Rus, V et al. (2002) "Expression of cytokine- and chemokine-related genes in peripheral blood mononuclear cells from lupus patients by cDNA array" *Clin Immunol* 102 (3): 283-90.

Saiura, Akio et al. (2001) "A Comparison of Gene Expression in Murine Cardiac Allografts and Isogxafts by Means DNA Microarray Analysis" *Transplantation* 72 (2): 320-329.

Salmon, J. E. et al. (1996) "Fc-gamma-RIIa alleles are heritable risk factors for lupus nephritis in African Americans" *J Clin. Invest.* 97: 1348-1354.

Schena, Mark et al. (1995) "Quantitative Monitoring of Gene Expression Patterns with a Complementary DNA Microarray" *Science* 270: 467-470.

Schena, Mark et al. (1996) "Parallel human genome analysis: Microarray-based expression monitoring of 1000 genes" *Proc. Natl. Acad. Sci. USA* 93: 10614-10619.

Schowengerdt et al (2000) "Increased expression of the lymphocyte early activation marker CD69 in peripheral blood correlates with histologic evidence of cardiac allograft rejection." *Transplantation* 69(10):2102-7.

Sharma, Vijay K. et al. (1996) "Molecular Executors of Cell Death-Differential Intrarenal Expression of Fas Ligand, Fas, Granzyme B, and Perforin During Acute and/or Chronic Rejection of Human Renal Allografts" *Transplantation* 62 (12): 1860-1866.

Shi, S.N. (1987) "Serum interferon in systemic lupus erythematosus" *Br. J Dermatol.* 117:155-159.

Shirali, G. S. et al. (2001) "Association of viral genome with graft loss in children after cardiac transplantation" *N. Engl. J. Med.* 344: 1498-503.

Shoker, Ahmed et al. (2000) "Heightened CD40 Ligand Gene Expression in Peripheral CD4+ Cells from Patients with Kidney Allograft Rejection" *Transplantation* 70 (3): 497-505.

Shulzhenko, Natalia et al. (2001) "Intragraft Activation of Genes Encoding Cytotoxic T Lymphocyte Effector Molecules Precedes the Histological Evidence of Rejection in Human Cardiac Transplantation" *Transplantation* 72 (10): 1705-1708.

Shulzhenko, Natalia et al. (2001) "Monitoring of Intragraft and Peripheral Blood TIRC7 Expression as a Diagnostic Tool for Acute Cardiac Rejection in Humans" *Human Immunology* 62: 342-347.

Staudt, L. M. And P. O. Brown. (2000) "Genomic Views of the Immune System" *Annu. Rev. Immunol.* 18: 829-859.

Strehlau, Jurgen et al. (1997) "Quantitative detection of immune activation transcripts as a diagnostic tool in kidney transplantation" *Proc. Natl. Acad. Sci. USA* 94: 695-700.

Tan, E. M. et al. (1982) "The 1982 revised criteria for the classification of systemic lupus erythematosus" *Arthritis Rheum.* 25: 1271-7.

Tan, LamChin et al. (2001) "Sequential Monitoring of Peripheral T-Lymphocyte Cytokine Gene Expression in the Early Post Renal Allograft Period" *Transplantation* 71: 751-759.

Toogood, Giles J. et al. (1996) "The Immune Response Following Small Bowel Transplantation" *Transplantation* 62 (6): 851-855.

Törönen, Petri et al. (1999) "Analysis of gene expression data using self-organizing maps" *FEBS Letters* 451: 142-146.

Torre-Amione, G. et al. (1996) "Proinflammatory cytokine levels in patients with depressed left ventricular ejection fraction: a report from the Studies of Left Ventricular Dysfunction (SOLVD)" *J Am. Coll. Cardiol.* 27: 1201-6.

Tsutamoto, T. et al. (2000) "Angiotensin II type 1 receptor antagonist decreases plasma levels of tumor necrosis factor alpha, interleukin-6 and soluble adhesion molecules in patients with chronic heart failure" *J. Am. Coll. Cardio.* 35: 714-21.

Tusher, Virginia Goss et al. (2001) "Significance analysis of microarrays applied to the ionizing radiation response" *PNAS* 98 (9) 5116-5121.

Umek, R. M. et al. (2001) "Electronic detection of nucleic acids: a versatile platform for molecular diagnostics" *J. Mol. Diagn.* 3: 74-84.

Vallin, H. (1999) "Anti-double-stranded DNA antibodies and immunostimulatory plasmid DNA in combination mimic the endogenous IFN-alpha inducer in systemic lupus erythematosus" *J. Immunol.* 163: 6306-6313.

Vandevyver, Caroline et al. (1998) "Cytokine mRNA Profile of Myelin Basic Protein Reactive T-Cell Clones in Patients with Multiple Sclerosis" *Autoimmunity* 28: 77-89.

Vasconcellos, Lauro M. et al. (1998) "Cytotoxic Lymphocyte Gene Expression in Peripheral Blood Leukocytes Correlates with Rejecting Renal Allografts" *Transplantation* 66 (5): 562-566.

Vignali D. (2000) "Multiplexed particle-based flow cytometric assays" *J. Immun. Meth.* 243: 243-55.

Vincenti, F. et al. (2001) "Multicenter Trial Exploring Calcineurin Inhibitors Avoidance in Renal Transplantation" *Transplantation* 71(9): 1282-1287.

Watanabe-Fukunaga, R. et al. (1992) "Lymphoproliferation disorder in mice explained by defects in Fas antigen that mediates apoptosis" *Nature* 356: 314-317.

Welsh, J. B. et al. (2001) "Analysis of gene expression profiles in normal and neoplastic ovarian tissue samples identifies candidate molecular markers of epithelial ovarian cancer" *Proc. Natl. Acad. Sci. U.S.A.* 98: 1176-81.

Westin L. et al. (2000) "Anchored multiplex amplification on a microelectronic chip array" *Nat. Biotechnol.* 18: 199-204.

Whitehead, John. 2002. An Introduction to Logistic Regression. (web page: http://personal.ecu.edu/whiteheadj/data/logit/). Apr. 25, 2002: 63 pages.

Wu, J. et al. (1996) "Fas ligand mutation in a patient with systemic lupus erythematosus and lymphoproliferative disease" *J. Clin. Invest.* 98: 1107-1113.

Xia, Dongyuan et al. (2001) "Real-Time Polymerase Chain Reaction Analysis Reveals an Evolution of Cytokine mRNA Production in Allograft Acceptor Mice" *Transplantation* 72 (5): 907-914.

Yu et al. (2000) "Protein Synthesis-Dependent and Independent Induction of p69 2'-5'-Oligoadenylate Synthetase by Interferon-$\alpha$," *Cytokine*, 11(10): 744-750.

Zhang, L. et al. (1997) "A New Interferon Regulatory Factor Associated with Epstein=Barr Virus Latency." Molecular and Cellular Biology, 17(10): 5748-5757.

Zucker, S. et al. (1999) "Increased serum stromelysin-1 levels in systemic lupus erythematosus: lack of correlation with disease activity." *J Rheumatol.* 26 (1): 78-80.

Alizadeh, A. A. et al. (2000). "Genomic-Scale Gene Expression Profiling of Normal and Malignant Immune Cells," *Current Opinion in Immunology* 12:219-225.

Glynne, R. et al. (2000). "B-Lymphocyte Quiescence, Tolerance and Activation as Viewed by Global Gene Expression Profiling on Microarrays," *Immunological Reviews* 176:216-246.

Glynne, R. J. et al. (2000). "Genomic-Scale Gene Expression Analysis of Lymphocyte Growth, Tolerance and Malignancy," *Current Opinion in Immunology* 12:210-214.

Marrack, P. et al. (2000). "Genomic-Scale Analysis of Gene Expression in Resting and Activated T Cells," *Current Opinion in Immunology* 12:208-209.

Supplemental Partial European Search Report mailed Jul. 9, 2007, for EP Application No. 01997055.7 filed Oct. 22, 2001, 6 pages.

International Search Report mailed Sep. 23, 2005, for PCT application No. PCT/US03/12946, filed Apr. 24, 2003, 3 pages.

Ahern, H. (Jul. 24, 1995). "Biochemical, Reagent Kits Offer Scientists Good Return on Investment," *The Scientist* 9(15):20-24.

Cheung, V. et al. (Mar. 2003). "Natural Variation in Human Gene Expression Assessed in Lymphoblastoid Cells," *Nature Genetics* 33:422-425.

GenBank Accession No. Y10376, last updated May 14, 1997, located at <http://www.ncbi.nlm.nih.gov/entrez/viewerfcgi?db=nuccore&id=2052057> visited on Apr. 8, 2008, 3 pages.

International Search Report and Written Opinion mailed Mar. 27, 2008, for PCT Application No. PCT/US05/31806 filed Sep. 8, 2005, 14 pages.

Newton, M. A. et al. (2001). "On Differential Variability of Expression Ratios: Improving Statistical Inference about Gene Expression Changes from Microarray Data," *Journal of Computational Biology* 8(1):37-52.

U.S. Office Action mailed Jun. 15, 2007, for U.S. Appl. No. 11/223,492, filed Sep. 8, 2005, 20 pages.

U.S. Office Action mailed Mar. 5, 2008, for U.S. Appl. No. 11/223,492, filed Sep. 8, 2005, 13 pages.

U.S. Office Action mailed Oct. 3, 2007, for U.S. Appl. No. 10/990,275, filed Nov. 15, 2004, 6 pages.

U.S. Office Action mailed Oct. 5, 2007, for U.S. Appl. No. 10/990,298, filed Nov. 15, 2004, 5 pages.

U.S. Appl. No. 10/512,028, filed Apr. 14, 2006 for Wohlgemuth et al.

U.S. Appl. No. 11/938,227, filed Nov. 9, 2007 for Lal et al.

Wu, T. (2001). "Analyzing Gene Expression Data from DNA Microarrays to Identify Candidate Genes," *Journal of Pathology* 195:53-65.

Bertone, P. et al. (Dec. 24, 2004). "Global Identification of Human Transcribed Sequences with Genome Tiling Arrays," *Science* 306:2242-2246.

Flechner, S. M. et al. (2004). "Kidney Transplant Rejection and Tissue Injury by Gene Profiling of Biopsies and Peripherals Blood Lymphocytes," *American Journal of Transplantation* 4:1475-1489.

Galon, J. et al. (Jan. 2002). "Gene Profiling Reveals Unknown Enhancing and Supppressive Actions of Glucocorticoids on Immune Cells," *The FASEB Journal* 16:61-71.

International Search Report and Written Opinion mailed Aug. 25, 2008, for PCT Application No. PCT/U507/08909 filed Apr. 9, 2007, 10 pages.

International Search Report and Written Opinion mailed Jun. 25, 2008, for PCT Application No. PCT/US06/18381 filed May 11, 2006, 8 pages.

Mansfield, E. S. et al. (2004). "Arraying the Orchestration of Allograft Pathology," *American Journal of Transplantation* 4:853-862.

Amaro, A. et al. (1995). "Plasma Leukocyte Elastase Concentration in Angiographically Diagnosed Coronary Artery Disease," *European Heart Journal* 16:615-622.

Aukrust, P. et al. (1999). "Enhanced Levels of Soluble and Membrane-Bound CD40 Ligand in Patients with Unstable Angina. Possible Reflection of T Lymphocyte and Platelet Involvement in the Pathogenesis of Acute Coronary Syndromes," *Circulation* 100:614-620.

Bass, C. A. (Oct. 1993). "Clinical Evaluation of a New Polymerase Chain Reaction Assay for Detection of Chlamydia trachomatis in Endocervical Specimens," *Journal of Clinical Microbiology* 31(10):2648-2653.

Belch, J. J. F. et al. (Apr. 1997). "The White Blood Cell Adhesion Molecule E-Selectin Predicts Restenosis in Patients With Intermittent Claudication Undergoing Percutaneous Transluminal Angioplasty," *Circulation* 95(8):2027-2031.

Boelaert, M. et al. (May 1999). "Latent Class Analysis Permits Unbiased Estimates of the Validity of DAT for the Diagnosis of Visceral Leishmaniasis," *Tropical Medicine & International Health* 4(5):395-401.

Bustin, S. A. (2000). "Absolute Quantification of mRNA Using Real-Time Reverse Transcription Polymerase Chain Reaction Assays," *Journal of Molecular Endocrinology* 25:169-193.

Chen, J. et al. (Aug. 1996). "Identification of Differentially Expressed Genes in Rat Aortic Allograft Vasculopathy," *American Journal of Pathology* 149(2):597-611.

Fandrey, J. et al. (Feb. 1, 1993). "In Vivo and In Vitro Regulation of Erythropoietin mRNA: Measurement by Competitive Polymerase Chain Reaction," *Blood* 81(3):617-623.

Harlow, E. et al. (1988). *Antibodies: A Laboratory Manual.* Cold Spring Harbor Laboratory: New York, NY, 9 pages (Table of Contents).

Hayward, A. L. et al. (1998). "Modeling and Analysis of Competitive RT-PCR," *Nucleic Acids Research* 26(11):2511-2518.

Hayward-Lester, A. et al. (1995). "Accurate and Absolute Quantitative Measurement of Gene Expression by Single Tube RT-PCR and HPLC," *Genome Research* 5:494-499.

International Search Report mailed Jul. 18, 2002, for PCT Application No. PCT/US01/47856 filed Oct. 22, 2001, 3 pages.

International Search Report mailed Mar. 1, 2001, for PCT Application No. PCT/US00/17846 filed Jun. 28, 2000, 2 pages.

Jude, B. et al. (Oct. 1994). "Evidence for Time-Dependent Activation of Monocytes in the Systemic Circulation in Unstable Angina but Not in Acute Myocardial Infarction or in Stable Angina," *Circulation* 90(4):1662-1668.

Kang, J. J. et al. (2000). "Transcript Quantitation in Total Yeast Cellular RNA Using Kinetic PCR," *Nucleic Acids Research* 28(2):e2, 8 pages.

Kassirer, M. et al. (Sep. 1999). "Increased Expression of the CD11b/CD18 Antigen on the Surface of Peripheral White Blood Cells in Patients with Ischemic Heart Disease: Further Evidence for Smoldering Inflammation in Patients with Atherosclerosis," *American Heart Journal* 138(3):555-559.

Kendler, K. S. et al. (Jun. 1998). "The Structure of Psychosis Latent Class Analysis of Probands from the Roscommon Family Study," *Archives of General Psychiatry* 55:492-499.

Lee, M.-T. et al. (Aug. 29, 2000). "Importance of Replication in Microarray Gene Expression Studies: Statistical Methods and Evidence from Repetitive cDNA Hybridizations," *Proceedings of the National Academy of Sciences* 97(18):9834-9839.

Pickles, A. et al. (1995). "Latent-Class Analysis of Recurrence Risks for Complex Phenotypes with Selection and Measurement Error: A Twin and Family History Study of Autism," *American Journal of Human Genetics* 57:717-726.

Ross, S. D. et al. (1999). "Reduced Neutrophil Infiltration Protects Against Lung Reperfusion Injury After Transplantation," *The Annals of Thoracic Surgery* 67: 1428-1434.

Smith-Norowitz, T. A. et al. (Nov. 1999). "Lymphocyte Activation in Angina Pectoris," *Clinical Immunology* 93(2):168-175.

Stites, D. P. et al. eds. (1991). *Basic and Clinical Immunology.* 7th Edition, Appleton & Lange: East Norwalk, CT, 6 pages (Table of Contents).

Thomas, E. et al. (Jul. 2000). "Subtyping of Juvenile Idiopathic Arthritis Using Latent Class Analysis," *Arthritis & Rheumatism* 43(7):1496-1503.

Tibshirani, R. et al. (May 2002). "Diagnosis of Multiple Cancer Types by Shrunken Centroids of Gene Expression," *Proceedings of the National Academy of Sciences* 99(1):6567-6572.

Vu, H. K. (2000). "A Method for Quantification of Absolute Amounts of Nucleic Acids by (RT)-PCR and a New Mathematical Model for Data Analysis," *Nucleic Acids Research* 28(7):e18, 9 pages.

International Search Report and Written Opinion mailed Sep. 10, 2008, for PCT Application No. PCT/US07/18135 filed Aug. 14, 2007, 12 pages.

Keembiyehetty, C. et al. (Mar. 2006). "Mouse Glucose Transporter 9 Splice Variants Are Expressed in Adult Liver and Kidney and Are Up-regulated in Diabetes," *Molecular Endocrinology* 20(3):686-697.

Kelsen, S. et al. (2004). "The Chemokine Receptor CXCR3 and its Splice Variant are Expressed in Human Airway Epithelial Cells," *American Journal of Physiology-Lung Cellular and Molecular Physiology* 287:L584-L591.

Quattrone, A. et al. (1995). "Quantitation of bcl-2 Oncogene in Cultured Lymphoma/Leukemia Cell Lines and in Primary Leukemia B-Cells by a Highly Sensitive RT-PCR Method," *Haematologica* 80:495-504.

Seiter, S. et al. (1998). "CD44 Variant Isoforrn Expression in a Variety of Skin-Associated Autoimmune Diseases," *Clinical Immunology and Immunopathology* 89(1):79-93.

U.S. Office Action mailed Jul. 18, 2008, for U.S. Appl. No. 10/990,275, filed Nov. 15, 2004, 4 pages.

U.S. Office Action mailed Sep. 19, 2008, for U.S. Appl. No. 10/512,028, filed Jul. 21, 2005, 6 pages.

U.S. Appl. No. 12/235,969, filed Sep. 23, 2008 for Wohlgemuth et al.

Zhu, H. et al. (Nov. 2005). "The Role of Hyaluronan Receptor CD44 in MSC Migration in The Extracellular Matrix," *Stem Cells Express* 1-32.

Japanese Notice of Reasons for Rejection mailed on Apr. 27, 2009 for Japanese Patent Application No. 2004-549874 filed on Apr. 24, 2003, 9 pages. [English Translation only].

Japanese Notice of Reasons for Rejection mailed on May 26, 2009 for Japanese Patent Application No. 2003-587333 filed on Apr. 24, 2003, 6 pages. [English Translation, 9 pages].

U.S. Appl. No. 12/329,173, filed Dec. 5, 2008 for Wohlgemuth et al.

U.S. Appl. No. 12/544,182, filed Aug. 19, 2009 for Wohlgemuth et al.

U.S. Appl. No. 12/561,213, filed Sep. 16, 2009 for Wohlgemuth et al.

U.S. Appl. No. 12/584,615, filed Sep. 8, 2009 for Wohlgemuth et al.

Zanders, E. et al. (2000). "Analysis of Immune System Gene Expression in Small Rheumatoid Arthritis Biopsies Using a Combination of Subtractive Hybridization and High-Density cDNA Arrays," *Journal of Immunological Methods* 233(1-2):131-140.

Benner, S. A. et al. (Jul. 2001). "Evolution, Language and Analogy in Functional Genomics," *Trends in Genetics* 17(7):414-418.

Bennett, L. et al. (Mar. 17, 2003). "Interferon and Granulopoiesis Signatures in Systemic Lupus Erythematosus Blood," *The Journal of Experimental Medicine* 197(6):711-723.

Bergholdt, R. et al. (2000). "Characterization of New Polymorphisms in the 5' UTR of the Human Interleukin-1 Receptor Type 1 (IL1R1) Gene: Linkage to Type 1 Diabetes and Correlation to IL-1RI Plasma Level," *Genes and Immunity* 1:495-500.

Centola, M. et al. (2006). "Genome-Scale Assessment of Molecular Pathology in Systemic Autoimmune Diseases Using Microarray Technology: A Potential Breakthrough Diagnostic and Individualized Therapy-Design Tool," *Scandinavian Journal of Immunology* 64:236-242.

Crow, M. K. et al. (2003). "Microarray Analysis of Gene Expression in Lupus," *Arthritis Research & Therapy* 5(6):279-287.

Dozmorov, M. G. et al. (2007). "$5\alpha$-Androstane-$3\alpha$, $17\beta$-Diol Selectively Activates the Canonical PI3K/AKT Pathway: A Bioinformatics-Based Evidence for Androgen-Activated Cytoplasmic Signaling," *Genomic Medicine* 1:139-146.

Horwitz, P. A. et al. (2004). "Detection of Cardiac Allograft Rejection and Response to Immunosuppressive Therapy with Peripheral Blood Gene Expression," *Circulation* 110:3815-3821.

Ing N. H. (2005). "Steroid Hormones Regulate Gene Expression Posttranscriptionally by Altering the Stabilities of Messenger RNAs," *Biology of Reproduction* 72:1290-1296.

Invitation to Pay Additional Fees mailed Apr. 27, 2009, for PCT Application No. PCT/U52007/023675 filed Nov. 9, 2007, 6 pages.

Kaufman, D. B. et al. (1997). "Functional Significance of Donor Islet Interleukin-1 Receptor Type 1 (IL-1Rt1) Expression in Islet Transplantation," *Transplantation Proceedings* 29:772-773.

Kirou, K. A. et al. (Dec. 2004). "Coordinate Overexpression of Interferon-$\alpha$-Induced Genes in Systemic Lupus Erythematosus," *Arthritis & Rheumatism* 50(12):3958-3967.

Mandel, M. et al. (2006). "Gene Expression Studies in Systemic Lupus Erythematosus," *Lupus* 15:451-456.

Smith, A. D. et al. eds. (1997). *Oxford Dictionary of Biochemistry and Molecular Biology*. Oxford University Press, Oxford, New York, p. 618.

Tanaka, J. et al. (1995). "Cytokine Receptor Gene Expression in Peripheral Blood Mononuclear Cells During Graft-Versus-Host Disease After Allogeneic Bone Marrow Transplantation," *Leukemia and Lymphoma* 19:281-287.

U.S. Office Action mailed Dec. 4, 2008, for U.S. Appl. No. 11/223,492, filed Sep. 8, 2005, 18 pages.

U.S. Office Action mailed May 29, 2009, for U.S. Appl. No. 11/784,998, filed Apr. 9, 2007, 28 pages.

U.S. Office Action mailed May 29, 2009, for U.S. Appl. No. 11/893,236, filed Aug. 14, 2007, 12 pages.

Vamvakopoulos, J. et al. (2002). "Genetic Control of IL-1$\beta$ Bioactivity Through Differential Regulation of the IL-1 Receptor Antagonist," *European Journal of Immunology* 32:2988-2996.

* cited by examiner

Figure 1: Novel Gene Sequence Analysis

Figure 2. Automated Mononuclear Cell RNA Isolation Device

Figure 7: Cardiac Allograft rejection diagnostic genes.
A.
| | | Marker Gene Expression Ratios | | | | |
|---|---|---|---|---|---|---|
| Sample | Grade | 3020 | 3019 | 2760 | 3018 | 85 |
| 12-0025-02 | 0 | 3.90 | 3.69 | 5.49 | 3.24 | 3.34 |
| 12-0024-04 | 0 | 3.66 | 4.05 | 5.89 | 3.75 | 3.03 |
| 15-0024-01 | 0 | 3.55 | 4.01 | 5.61 | 2.90 | 3.23 |
| 12-0029-03 | 0 | 3.44 | 3.12 | 4.25 | 3.55 | 3.07 |
| 12-0024-03 | 0 | 2.88 | 2.54 | 2.56 | 2.20 | 2.38 |
| 14-0021-05 | 0 | 1.31 | 1.03 | 1.07 | 0.91 | 0.99 |
| 14-0005-06 | 3A | 0.42 | 0.27 | 0.51 | 0.22 | 0.26 |
| 14-0012-07 | 3A | 0.60 | 0.62 | 0.70 | 0.42 | 0.61 |
| 14-0001-06 | 3A | 0.93 | 0.71 | 0.58 | 0.37 | 0.44 |
| 14-0009-01 | 3A | 0.71 | 0.63 | 0.68 | 0.61 | 0.66 |
| 12-0012-02 | 3A | 0.86 | 0.85 | 0.73 | 0.41 | 0.72 |
| 12-0001-01 | 3A | 1.08 | 0.97 | 1.01 | 0.40 | 1.06 |
| Average Grade 0: | | 3.13 | 3.07 | 4.14 | 2.76 | 2.67 |
| Average Grade 3A: | | 0.77 | 0.68 | 0.70 | 0.40 | 0.62 |
| Fold Difference: | | 4.08 | 4.55 | 5.91 | 6.82 | 4.28 |
B. CART classification model.
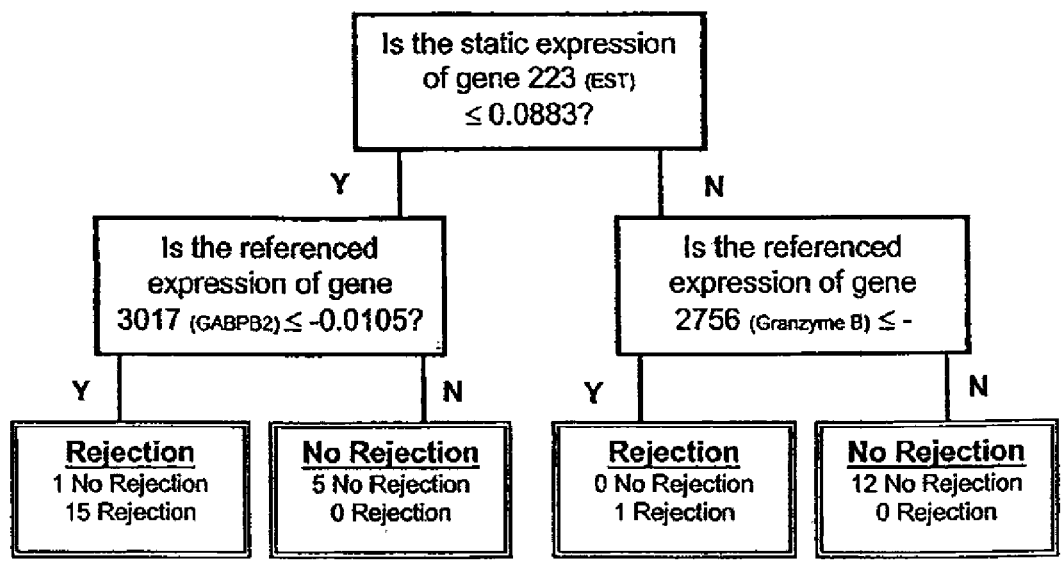

Figure 7 C. Surrogates for the CART classification model.

| Primary Splitter | static 223 | ref 3017 | ref 4 |
|---|---|---|---|
| Surrogate 1 | ref 167 | ref 102 | ref 2761 |
| Surrogate 2 | ref 3016 | static 36 | ref 2762 |
| Surrogate 3 | ref 1760 | ref 2764 | ref 3016 |
| Surrogate 4 | ref 85 | ref 2759 | ref 2757 |
| Surrogate 5 | ref 2763 | ref 2761 | ref 2758 |

Figure 8A: Validation of differential expression of Granzyme B in CMV patients using Real-time PCR
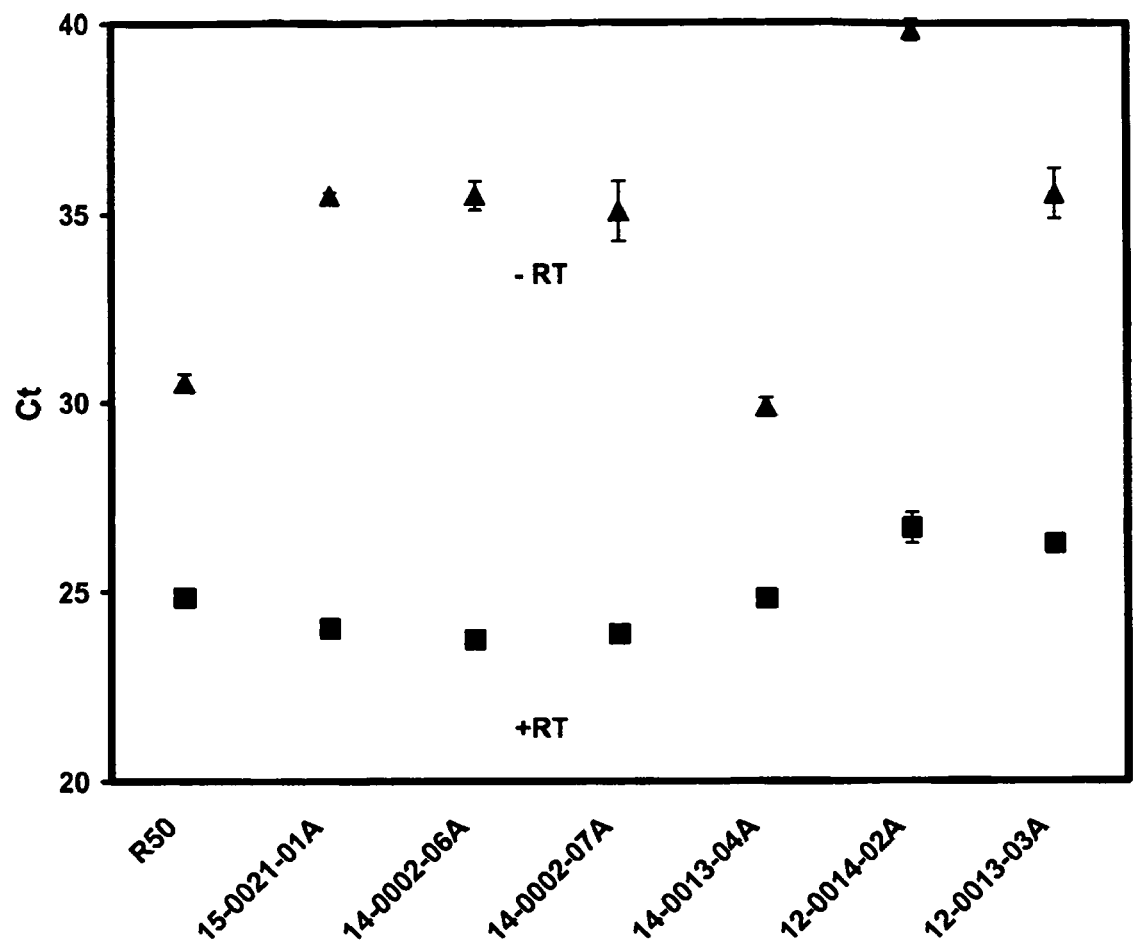

Figure 11
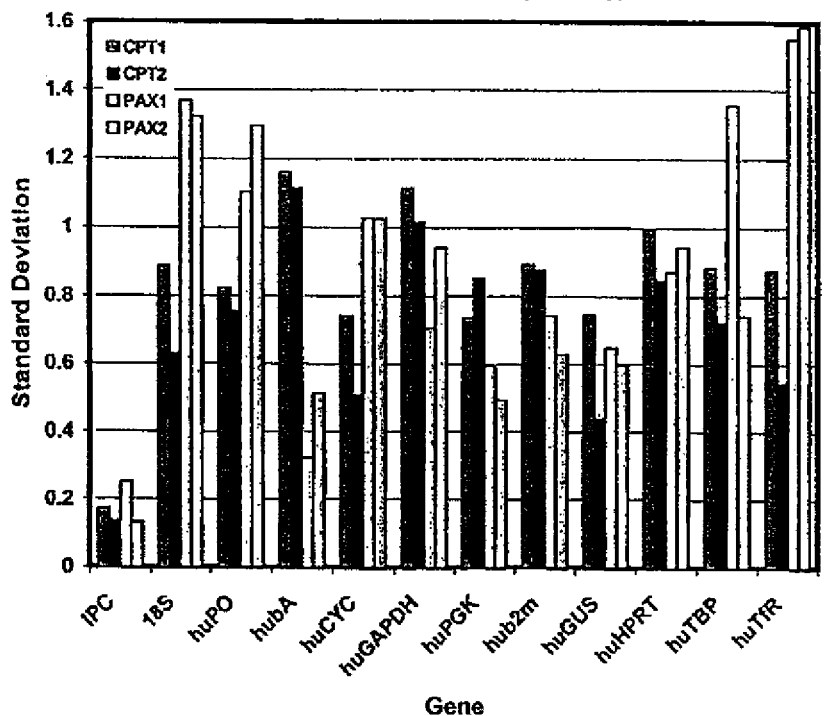
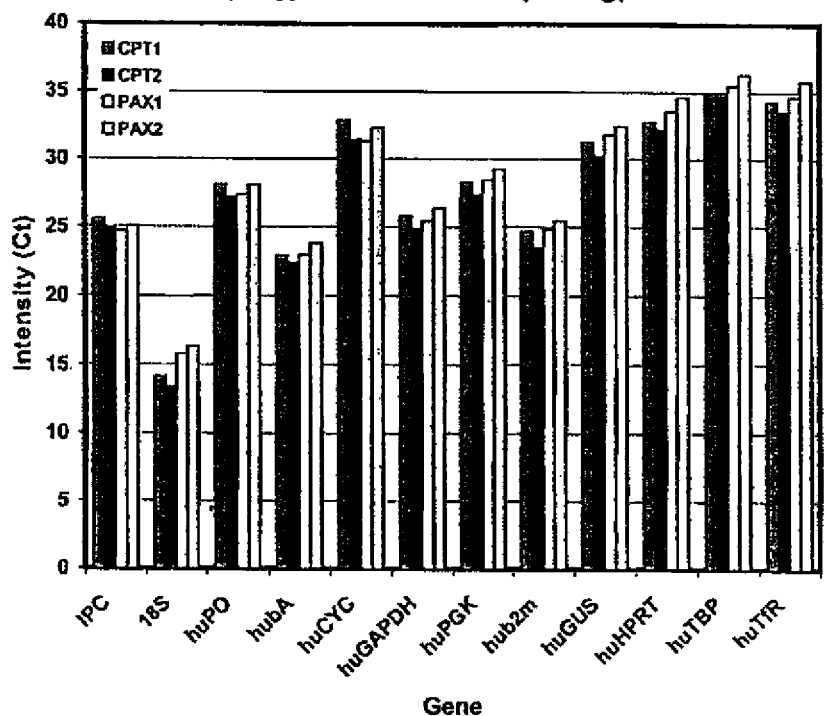

METHODS AND COMPOSITIONS FOR DIAGNOSING AND MONITORING TRANSPLANT REJECTION

RELATED APPLICATIONS

This application is a U.S. National Phase Application of International Application Serial No. PCT/US03/12946, filed Apr. 24, 2003, which claims priority to U.S. patent application Ser. No. 10/131,831, filed Apr. 24, 2002, and Ser. No. 10/325,899 filed Dec. 20, 2002, all of which are hereby incorporated by reference in their entirety.

FIELD OF THE INVENTION

This invention is in the field of expression profiling following organ transplantation.

BACKGROUND OF THE INVENTION

Many of the current shortcomings in diagnosis, prognosis, risk stratification and treatment of disease can be approached through the identification of the molecular mechanisms underlying a disease and through the discovery of nucleotide sequences (or sets of nucleotide sequences) whose expression patterns predict the occurrence or progression of disease states, or predict a patient's response to a particular therapeutic intervention. In particular, identification of nucleotide sequences and sets of nucleotide sequences with such predictive value from cells and tissues that are readily accessible would be extremely valuable. For example, peripheral blood is attainable from all patients and can easily be obtained at multiple time points at low cost. This is a desirable contrast to most other cell and tissue types, which are less readily accessible, or accessible only through invasive and aversive procedures. In addition, the various cell types present in circulating blood are ideal for expression profiling experiments as the many cell types in the blood specimen can be easily separated if desired prior to analysis of gene expression. While blood provides a very attractive substrate for the study of diseases using expression profiling techniques, and for the development of diagnostic technologies and the identification of therapeutic targets, the value of expression profiling in blood samples rests on the degree to which changes in gene expression in these cell types are associated with a predisposition to, and pathogenesis and progression of a disease.

Hematopoiesis is the development and maturation of all cell types of the blood. These include erythrocytes, platelets and leukocytes. Leukocytes are further subdivided into granulocytes (neutrophils, eosinophils, basophils) and mononuclear cells (monocytes, lymphocytes). These cells develop and mature from precursor cells to replenish the circulating pool and to respond to insults and challenges to the system. This occurs in the bone marrow, spleen, thymus, liver, lymph nodes, mucosal associated lymphoid tissue (MALT) and peripheral blood.

Precursor cells differentiate into immature forms of each lineage and these immature cells develop further into mature cells. This process occurs under the influence and direction of hematopoietic growth factors. When hematopoiesis is stimulated, there is an increase in the number of immature cells in the peripheral blood and in some cases, precursor cells are found at increased frequency. For example, CD34+ cells (hematopoietic stem cells) may increase in frequency in the peripheral blood with an insult to the immune system. For neutrophils, "band" forms are increased, for erythrocytes, reticulocytes or nucleated red cells are seen. Lymphocytes are preceeded by lymphoblasts (immature lymphocytes).

It may be an important clinical goal to measure the rate of production of blood cells of a variety of lineages. Hematological disorders involving over or under production of various blood cells may be treated pharmacologically. For example, anemia (low red blood cells) may be treated with erythropoietin (a hematopoietic growth factor) and response to this therapy can be assessed by measuring RBC production rates. Low neutrophils counts can be treated by administration of G-CSF and this therapy may be monitored by measuring neutrophil production rates. Alternatively, the diagnosis of blood cell disorders is greatly facilitated by determination of lineage specific production rates. For example, anemia (low RBCs) may be caused by decreased cellular production or increased destruction of cells. In the latter case, the rate of cellular production will be increased rather than decreased and the therapeutic implications are very different. Further discussion of the clinical uses of measures of blood cell production rates is given in below.

Assessment of blood cell production rates may be useful for diagnosis and management of non-hematological disorders. In particular, acute allograft rejection diagnosis and monitoring may benefit from such an approach. Current diagnosis and monitoring of acute allograft rejection is achieved through invasive allograft biopsy and assessment of the biopsy histology. This approach is sub-optimal because of expense of the procedure, cost, pain and discomfort of the patient, the need for trained physician operators, the risk of complications of the procedure, the lack of insight into the functioning of the immune system and variability of pathological assessment. In addition, biopsy can diagnose acute allograft rejection only after significant cellular infiltration into the allograft has occurred. At this point, the process has already caused damage to the allograft. For all these reasons, a simple blood test that can diagnose and monitor acute rejection at an earlier stage in the process is needed. Allograft rejection depends on the presence of functioning cells of the immune system. In addition, the process of rejection may cause activation of hematopoiesis. Finally, effective immunosuppressive therapy to treat or prevent acute rejection may suppress hematopoiesis. For these reasons, assessment of hematopoietic cellular production rates may be useful in the diagnosis and monitoring of acute rejection.

Current techniques for measuring cellular development and production rates are inadequate. The most common approach is to measure the number of mature cells of a lineage of interest over time. For example, if a patient is being treated for anemia (low red blood cell counts), then the physician will order a blood cell count to assess the number of red blood cells (RBCs) in circulation. For this to be effective, the physician must measure the cell count over time and may have to wait 2-4 weeks before being able to assess response to therapy. The same limitation is true for assessment of any cell lineage in the blood.

An alternative approach is to count the number of immature cells in the peripheral blood by counting them under the microscope. This may allow a more rapid assessment of cellular production rates, but is limited by the need for assessment by a skilled hematologist, observer variability and the inability to distinguish all precursor cells on the basis of morphology alone.

Bone marrow biopsy is the gold standard for assessment of cellular production rates. In addition to the limitations of the need for skilled physicians, reader variability and the lack of sensitivity of morphology alone, the technique is also limited by the expense, discomfort to the patient and need for a prolonged visit to a medical center. Thus there is a need for a reliable, rapid means for measuring the rate of hematopoeisis in a patient.

In addition to the relationship between hematopoiesis and variety of disease processes, there is an extensive literature supporting the role of leukocytes, e.g., T- and B-lymphocytes, monocytes and granulocytes, including neutrophils, in a wide range of disease processes, including such broad classes as cardiovascular diseases, inflammatory, autoimmune and rheumatic diseases, infectious diseases, transplant rejection, cancer and malignancy, and endocrine diseases. For example, among cardiovascular diseases, such commonly occurring diseases as atherosclerosis, restenosis, transplant vasculopathy and acute coronary syndromes all demonstrate significant T cell involvement (Smith-Norowitz et al. (1999) *Clin Immunol* 93:168-175; Jude et al. (1994) *Circulation* 90:1662-8; Belch et al. (1997) *Circulation* 95:2027-31). These diseases are now recognized as manifestations of chronic inflammatory disorders resulting from an ongoing response to an injury process in the arterial tree (Ross et al. (1999) *Ann Thorac Surg* 67:1428-33). Differential expression of lymphocyte, monocyte and neutrophil genes and their products has been demonstrated clearly in the literature. Particularly interesting are examples of differential expression in circulating cells of the immune system that demonstrate specificity for a particular disease, such as arteriosclerosis, as opposed to a generalized association with other inflammatory diseases, or for example, with unstable angina rather than quiescent coronary disease.

A number of individual genes, e.g., CD11b/CD18 (Kassirer et al. (1999) *Am Heart J* 138:555-9); leukocyte elastase (Amaro et al. (1995) *Eur Heart J* 16:615-22; and CD40L (Aukrust et al. (1999) *Circulation* 100:614-20) demonstrate some degree of sensitivity and specificity as markers of various vascular diseases. In addition, the identification of differentially expressed target and fingerprint genes isolated from purified populations of monocytes manipulated in various in vitro paradigms has been proposed for the diagnosis and monitoring of a range of cardiovascular diseases, see, e.g., U.S. Pat. Nos. 6,048,709; 6,087,477; 6,099,823; and 6,124, 433 "COMPOSITIONS AND METHODS FOR THE TREATMENT AND DIAGNOSIS OF CARDIOVASCULAR DISEASE" to Falb (see also, WO 97/30065). Lockhart, in U.S. Pat. No. 6,033,860 "EXPRESSION PROFILES IN ADULT AND FETAL ORGANS" proposes the use of expression profiles for a subset of identified genes in the identification of tissue samples, and the monitoring of drug effects.

The accuracy of technologies based on expression profiling for the diagnosis, prognosis, and monitoring of disease would be dramatically increased if numerous differentially expressed nucleotide sequences, each with a measure of specificity for a disease in question, could be identified and assayed in a concerted manner. PCT application WO 02/057414 "LEUKOCYTE EXPRESSION PROFILING" to Wohlgemuth identifies one such set of differentially expressed nucleotides.

In order to achieve this improved accuracy, the sets of nucleotide sequences once identified need to be validated to identify those differentially expressed nucleotides within a given set that are most useful for diagnosis, prognosis, and monitoring of disease. The present invention addresses these and other needs, and applies to transplant rejection and detection of the rate of hematopoeisis for which differential regulation of genes, or other nucleotide sequences, of peripheral blood can be demonstrated.

SUMMARY OF THE INVENTION

In order to meet these needs, the present invention is thus directed to a system for detecting differential gene expression. In one format, method are provided for assessing the immune status of an individual by detecting the expression level of one or more genes expressed at different levels depending upon the rate of hematopoiesis or the distribution of hematopoietic cells along their maturation pathway in the individual. The one or more genes may include a nucleotide selected from a nucleotide sequence selected from SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, SEQ ID NO:97, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:140, SEQ ID NO:141, SEQ ID NO:142, SEQ ID NO:143, SEQ ID NO:144, SEQ ID NO:145, SEQ ID NO:146, SEQ ID NO:147, SEQ ID NO:148, SEQ ID NO:149, SEQ ID NO:150, SEQ ID NO:151, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:173, SEQ ID NO:174, SEQ ID NO:175, SEQ ID
NO:176, SEQ ID NO:177, SEQ ID NO:178, SEQ ID
NO:179, SEQ ID NO:180, SEQ ID NO:181, SEQ ID
NO:182, SEQ ID NO:183, SEQ ID NO:184, SEQ ID
NO:185, SEQ ID NO:186, SEQ ID NO:187, SEQ ID
NO:188, SEQ ID NO:189, SEQ ID NO:190, SEQ ID
NO:191, SEQ ID NO:192, SEQ ID NO:193, SEQ ID
NO:194, SEQ ID NO:195, SEQ ID NO:196, SEQ ID
NO:197, SEQ ID NO:198, SEQ ID NO:199, SEQ ID
NO:200, SEQ ID NO:201, SEQ ID NO:202, SEQ ID
NO:203, SEQ ID NO:204, SEQ ID NO:205, SEQ ID
NO:206, SEQ ID NO:207, SEQ ID NO:208, SEQ ID
NO:209, SEQ ID NO:210, SEQ ID NO:211, SEQ ID
NO:212, SEQ ID NO:213, SEQ ID NO:214, SEQ ID
NO:215, SEQ ID NO:216, SEQ ID NO:217, SEQ ID
NO:218, SEQ ID NO:219, SEQ ID NO:220, SEQ ID
NO:221, SEQ ID NO:222, SEQ ID NO:223, SEQ ID
NO:224, SEQ ID NO:225, SEQ ID NO:226, SEQ ID
NO:227, SEQ ID NO:228, SEQ ID NO:229, SEQ ID
NO:230, SEQ ID NO:231, SEQ ID NO:232, SEQ ID
NO:233, SEQ ID NO:234, SEQ ID NO:235, SEQ ID
NO:236, SEQ ID NO:237, SEQ ID NO:238, SEQ ID
NO:239, SEQ ID NO:240, SEQ ID NO:241, SEQ ID
NO:242, SEQ ID NO:243, SEQ ID NO:244, SEQ ID
NO:245, SEQ ID NO:246, SEQ ID NO:247, SEQ ID
NO:248, SEQ ID NO:249, SEQ ID NO:250, SEQ ID
NO:251, SEQ ID NO:252, SEQ ID NO:253, SEQ ID
NO:254, SEQ ID NO:255, SEQ ID NO:256, SEQ ID
NO:257, SEQ ID NO:258, SEQ ID NO:259, SEQ ID
NO:260, SEQ ID NO:261, SEQ ID NO:262, SEQ ID
NO:263, SEQ ID NO:264, SEQ ID NO:265, SEQ ID
NO:266, SEQ ID NO:267, SEQ ID NO:268, SEQ ID
NO:269, SEQ ID NO:270, SEQ ID NO:271, SEQ ID
NO:272, SEQ ID NO:273, SEQ ID NO:274, SEQ ID
NO:275, SEQ ID NO:276, SEQ ID NO:277, SEQ ID
NO:278, SEQ ID NO:279, SEQ ID NO:280, SEQ ID
NO:281, SEQ ID NO:282, SEQ ID NO:283, SEQ ID
NO:284, SEQ ID NO:285, SEQ ID NO:286, SEQ ID
NO:287, SEQ ID NO:288, SEQ ID NO:289, SEQ ID
NO:290, SEQ ID NO:291, SEQ ID NO:292, SEQ ID
NO:293, SEQ ID NO:294, SEQ ID NO:295, SEQ ID
NO:296, SEQ ID NO:297, SEQ ID NO:298, SEQ ID
NO:299, SEQ ID NO:300, SEQ ID NO:301, SEQ ID
NO:302, SEQ ID NO:303, SEQ ID NO:304, SEQ ID
NO:305, SEQ ID NO:306, SEQ ID NO:307, SEQ ID
NO:308, SEQ ID NO:309, SEQ ID NO:310, SEQ ID
NO:311, SEQ ID NO:312, SEQ ID NO:313, SEQ ID
NO:314, SEQ ID NO:315, SEQ ID NO:316, SEQ ID
NO:317, SEQ ID NO:318, SEQ ID NO:319, SEQ ID
NO:320, SEQ ID NO:321, SEQ ID NO:322, SEQ ID
NO:323, SEQ ID NO:324, SEQ ID NO:325, SEQ ID
NO:326, SEQ ID NO:327, SEQ ID NO:328, SEQ ID
NO:329, SEQ ID NO:330, SEQ ID NO:331, SEQ ID
NO:332, SEQ ID NO:2697, SEQ ID NO:2645, SEQ ID
NO:2707, SEQ ID NO:2679, SEQ ID NO:2717, SEQ ID
NO:2646, SEQ ID NO:2667, SEQ ID NO:2706, SEQ ID
NO:2740, SEQ ID NO:2669, SEQ ID NO:2674, SEQ ID
NO:2743, SEQ ID NO:2716, SEQ ID NO:2727, SEQ ID
NO:2721, SEQ ID NO:2641, SEQ ID NO:2671, SEQ ID
NO:2752, SEQ ID NO:2737, SEQ ID NO:2719, SEQ ID
NO:2684, SEQ ID NO:2677, SEQ ID NO:2748, SEQ ID
NO:2703, SEQ ID NO:2711, SEQ ID NO:2663, SEQ ID
NO:2657, SEQ ID NO:2683, SEQ ID NO:2686, SEQ ID
NO:2687, SEQ ID NO:2644, SEQ ID NO:2664, SEQ ID
NO:2747, SEQ ID NO:2744, SEQ ID NO:2678, SEQ ID
NO:2731, SEQ ID NO:2713, SEQ ID NO:2736, SEQ ID
NO:2708, SEQ ID NO:2670, SEQ ID NO:2661, SEQ ID
NO:2680, SEQ ID NO:2754, SEQ ID NO:2728, SEQ ID
NO:2742, SEQ ID NO:2668, SEQ ID NO:2750, SEQ ID
NO:2746, SEQ ID NO:2738, SEQ ID NO:2627, SEQ ID
NO:2739, SEQ ID NO:2647, SEQ ID NO:2628, SEQ ID
NO:2638, SEQ ID NO:2725, SEQ ID NO:2714, SEQ ID
NO:2635, SEQ ID NO:2751, SEQ ID NO:2629, SEQ ID
NO:2695, SEQ ID NO:2741, SEQ ID NO:2691, SEQ ID
NO:2726, SEQ ID NO:2722, SEQ ID NO:2689, SEQ ID
NO:2734, SEQ ID NO:2631, SEQ ID NO:2656, SEQ ID
NO:2696, SEQ ID NO:2676, SEQ ID NO:2701, SEQ ID
NO:2730, SEQ ID NO:2710, SEQ ID NO:2632, SEQ ID
NO:2724, SEQ ID NO:2698, SEQ ID NO:2662, SEQ ID
NO:2753, SEQ ID NO:2704, SEQ ID NO:2675, SEQ ID
NO:2700, SEQ ID NO:2640, SEQ ID NO:2723, SEQ ID
NO:2658, SEQ ID NO:2688, SEQ ID NO:2735, SEQ ID
NO:2702, SEQ ID NO:2681, SEQ ID NO:2755, SEQ ID
NO:2715, SEQ ID NO:2732, SEQ ID NO:2652, SEQ ID
NO:2651, SEQ ID NO:2718, SEQ ID NO:2673, SEQ ID
NO:2733, SEQ ID NO:2712, SEQ ID NO:2659, SEQ ID
NO:2654, SEQ ID NO:2636, SEQ ID NO:2639, SEQ ID
NO:2690, SEQ ID NO:2705, SEQ ID NO:2685, SEQ ID
NO:2692, SEQ ID NO:2693, SEQ ID NO:2648, SEQ ID
NO:2650, SEQ ID NO:2720, SEQ ID NO:2660, SEQ ID
NO:2666, SEQ ID NO:2699, SEQ ID NO:2633, SEQ ID
NO:2672, SEQ ID NO:2642, SEQ ID NO:2682, SEQ ID
NO:2655, SEQ ID NO:2630, SEQ ID NO:2745, SEQ ID
NO:2643, SEQ ID NO:2694, SEQ ID NO:2749, SEQ ID
NO:2665, SEQ ID NO:2649, SEQ ID NO:2637, SEQ ID
NO:2634, SEQ ID NO:2709, SEQ ID NO:2653, SEQ ID
NO:2729. The expression level may be detected by measuring the RNA level expressed by the one or more genes. In one variation, the RNA level is detected by PCR. In another variation, the RNA level is detected by hybridization. The expression level may also be detected by measuring one or more proteins expressed by the one or more genes.

The present invention is further directed to methods of diagnosing or monitoring transplant rejection in an individual by detecting a rate of hematopoiesis. The detection may be applied directly to the individual, or to a sample isolated from the individual. Detection may be accomplished by RNA profiling assay, immunoassay, fluorescent activated cell sorting, protein assay, peripheral blood cytology assay, MRI imaging, bone marrow aspiration, and/or nuclear imaging. In one variation, the RNA profile assay is a PCR based assay. In another variation, the RNA profile assay is a hybridization based assay. The RNA profile assay may further include detecting the expression level of one or more genes in the individual where the one or more genes include a nucleotide sequence selected from SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, SEQ ID NO:97, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:140, SEQ ID NO:141, SEQ ID NO:142, SEQ ID NO:143, SEQ ID NO:144, SEQ ID NO:145, SEQ ID NO:146, SEQ ID NO:147, SEQ ID NO:148, SEQ ID NO:149, SEQ ID NO:150, SEQ ID NO:151, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:173, SEQ ID NO:174, SEQ ID NO:175, SEQ ID NO:176, SEQ ID NO:177, SEQ ID NO:178, SEQ ID NO:179, SEQ ID NO:180, SEQ ID NO:181, SEQ ID NO:182, SEQ ID NO:183, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, SEQ ID NO:217, SEQ ID NO:218, SEQ ID NO:219, SEQ ID NO:220, SEQ ID NO:221, SEQ ID NO:222, SEQ ID NO:223, SEQ ID NO:224, SEQ ID NO:225, SEQ ID NO:226, SEQ ID NO:227, SEQ ID NO:228, SEQ ID NO:229, SEQ ID NO:230, SEQ ID NO:231, SEQ ID NO:232, SEQ ID NO:233, SEQ ID NO:234, SEQ ID NO:235, SEQ ID NO:236, SEQ ID NO:237, SEQ ID NO:238, SEQ ID NO:239, SEQ ID NO:240, SEQ ID NO:241, SEQ ID NO:242, SEQ ID NO:243, SEQ ID NO:244, SEQ ID NO:245, SEQ ID NO:246, SEQ ID NO:247, SEQ ID NO:248, SEQ ID NO:249, SEQ ID NO:250, SEQ ID NO:251, SEQ ID NO:252, SEQ ID NO:253, SEQ ID NO:254, SEQ ID NO:255, SEQ ID NO:256, SEQ ID NO:257, SEQ ID NO:258, SEQ ID NO:259, SEQ ID NO:260, SEQ ID NO:261, SEQ ID NO:262, SEQ ID NO:263, SEQ ID NO:264, SEQ ID NO:265, SEQ ID NO:266, SEQ ID NO:267, SEQ ID NO:268, SEQ ID NO:269, SEQ ID NO:270, SEQ ID NO:271, SEQ ID NO:272, SEQ ID NO:273, SEQ ID NO:274, SEQ ID NO:275, SEQ ID NO:276, SEQ ID NO:277, SEQ ID NO:278, SEQ ID NO:279, SEQ ID NO:280, SEQ ID NO:281, SEQ ID NO:282, SEQ ID NO:283, SEQ ID NO:284, SEQ ID NO:285, SEQ ID NO:286, SEQ ID NO:287, SEQ ID NO:288, SEQ ID NO:289, SEQ ID NO:290, SEQ ID NO:291, SEQ ID NO:292, SEQ ID NO:293, SEQ ID NO:294, SEQ ID NO:295, SEQ ID NO:296, SEQ ID NO:297, SEQ ID NO:298, SEQ ID NO:299, SEQ ID NO:300, SEQ ID NO:301, SEQ ID NO:302, SEQ ID NO:303, SEQ ID NO:304, SEQ ID NO:305, SEQ ID NO:306, SEQ ID NO:307, SEQ ID NO:308, SEQ ID NO:309, SEQ ID NO:310, SEQ ID NO:311, SEQ ID NO:312, SEQ ID NO:313, SEQ ID NO:314, SEQ ID NO:315, SEQ ID NO:316, SEQ ID NO:317, SEQ ID NO:318, SEQ ID NO:319, SEQ ID NO:320, SEQ ID NO:321, SEQ ID NO:322, SEQ ID NO:323, SEQ ID NO:324, SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:2697, SEQ ID NO:2645, SEQ ID NO:2707, SEQ ID NO:2679, SEQ ID NO:2717, SEQ ID NO:2646, SEQ ID NO:2667, SEQ ID NO:2706, SEQ ID NO:2740, SEQ ID NO:2669, SEQ ID NO:2674, SEQ ID NO:2743, SEQ ID NO:2716, SEQ ID NO:2727, SEQ ID NO:2721, SEQ ID NO:2641, SEQ ID NO:2671, SEQ ID NO:2752, SEQ ID NO:2737, SEQ ID NO:2719, SEQ ID NO:2684, SEQ ID NO:2677, SEQ ID NO:2748, SEQ ID NO:2703, SEQ ID NO:2711, SEQ ID NO:2663, SEQ ID NO:2657, SEQ ID NO:2683, SEQ ID NO:2686, SEQ ID NO:2687, SEQ ID NO:2644, SEQ ID NO:2664, SEQ ID NO:2747, SEQ ID NO:2744, SEQ ID NO:2678, SEQ ID NO:2731, SEQ ID NO:2713, SEQ ID NO:2736, SEQ ID NO:2708, SEQ ID NO:2670, SEQ ID NO:2661, SEQ ID NO:2680, SEQ ID NO:2754, SEQ ID NO:2728, SEQ ID NO:2742, SEQ ID NO:2668, SEQ ID NO:2750, SEQ ID NO:2746, SEQ ID NO:2738, SEQ ID NO:2627, SEQ ID NO:2739, SEQ ID NO:2647, SEQ ID NO:2628, SEQ ID NO:2638, SEQ ID NO:2725, SEQ ID NO:2714, SEQ ID NO:2635, SEQ ID NO:2751, SEQ ID NO:2629, SEQ ID NO:2695, SEQ ID NO:2741, SEQ ID NO:2691, SEQ ID NO:2726, SEQ ID NO:2722, SEQ ID NO:2689, SEQ ID NO:2734, SEQ ID NO:2631, SEQ ID NO:2656, SEQ ID NO:2696, SEQ ID NO:2676, SEQ ID NO:2701, SEQ ID NO:2730, SEQ ID NO:2710, SEQ ID NO:2632, SEQ ID NO:2724, SEQ ID NO:2698, SEQ ID NO:2662, SEQ ID NO:2753, SEQ ID NO:2704, SEQ ID NO:2675, SEQ ID NO:2700, SEQ ID NO:2640, SEQ ID NO:2723, SEQ ID NO:2658, SEQ ID NO:2688, SEQ ID NO:2735, SEQ ID NO:2702, SEQ ID NO:2681, SEQ ID NO:2755, SEQ ID NO:2715, SEQ ID NO:2732, SEQ ID NO:2652, SEQ ID NO:2651, SEQ ID NO:2718, SEQ ID NO:2673, SEQ ID NO:2733, SEQ ID NO:2712, SEQ ID NO:2659, SEQ ID NO:2654, SEQ ID NO:2636, SEQ ID NO:2639, SEQ ID NO:2690, SEQ ID NO:2705, SEQ ID NO:2685, SEQ ID NO:2692, SEQ ID NO:2693, SEQ ID NO:2648, SEQ ID NO:2650, SEQ ID NO:2720, SEQ ID NO:2660, SEQ ID NO:2666, SEQ ID NO:2699, SEQ ID NO:2633, SEQ ID NO:2672, SEQ ID NO:2642, SEQ ID NO:2682, SEQ ID NO:2655, SEQ ID NO:2630, SEQ ID NO:2745, SEQ ID NO:2643, SEQ ID NO:2694, SEQ ID NO:2749, SEQ ID NO:2665, SEQ ID NO:2649, SEQ ID NO:2637, SEQ ID NO:2634, SEQ ID NO:2709, SEQ ID NO:2653, SEQ ID NO:2729. Transplant rejection may include one or more of heart transplant rejection, kidney transplant rejection, liver transplant rejection, pancreas transplant rejection, pancreatic islet transplant rejection, lung transplant rejection, bone marrow transplant rejection, stem cell transplant rejection, xenotransplant rejection, and mechanical organ replacement rejection.

In another aspect, the invention is directed to a method of diagnosing or monitoring transplant rejection in a patient by detecting the expression level of one or more genes in the patient to diagnose or monitor transplant rejection in the patient, wherein the one or more genes include a nucleotide sequence selected from SEQ ID NO:2, SEQ ID NO:3, SEQ ID NO:4, SEQ ID NO:5, SEQ ID NO:6, SEQ ID NO:7, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:82, SEQ ID NO:83, SEQ ID NO:84, SEQ ID NO:85, SEQ ID NO:86, SEQ ID NO:87, SEQ ID NO:88, SEQ ID NO:90, SEQ ID NO:91, SEQ ID NO:92, SEQ ID NO:93, SEQ ID NO:94, SEQ ID NO:95, SEQ ID NO:96, SEQ ID NO:98, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:173, SEQ ID NO:174, SEQ ID NO:175, SEQ ID NO:176, SEQ ID NO:177, SEQ ID NO:178, SEQ ID NO:179, SEQ ID NO:180, SEQ ID NO:181, SEQ ID NO:182, SEQ ID NO:183, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, SEQ ID NO:217, SEQ ID NO:218, SEQ ID NO:219, SEQ ID NO:220, SEQ ID NO:221, SEQ ID NO:222, SEQ ID NO:223, SEQ ID NO:224, SEQ ID NO:225, SEQ ID NO:226, SEQ ID NO:227, SEQ ID NO:228, SEQ ID NO:229, SEQ ID NO:230, SEQ ID NO:231, SEQ ID NO:232, SEQ ID NO:233, SEQ ID NO:234, SEQ ID NO:235, SEQ ID NO:236, SEQ ID NO:237, SEQ ID NO:238, SEQ ID NO:239, SEQ ID NO:240, SEQ ID NO:241, SEQ ID NO:242, SEQ ID NO:243, SEQ ID NO:244, SEQ ID NO:245, SEQ ID NO:246, SEQ ID NO:247, SEQ ID NO:248, SEQ ID NO:249, SEQ ID NO:250, SEQ ID NO:251, SEQ ID NO:252, SEQ ID NO:253, SEQ ID NO:254, SEQ ID NO:255, SEQ ID NO:256, SEQ ID NO:257, SEQ ID NO:258, SEQ ID NO:259, SEQ ID NO:260, SEQ ID NO:261, SEQ ID NO:262, SEQ ID NO:263, SEQ ID NO:264, SEQ ID NO:265, SEQ ID NO:266, SEQ ID NO:267, SEQ ID NO:268, SEQ ID NO:269, SEQ ID NO:270, SEQ ID NO:271, SEQ ID NO:272, SEQ ID NO:273, SEQ ID NO:274, SEQ ID NO:275, SEQ ID NO:276, SEQ ID NO:277, SEQ ID NO:278, SEQ ID NO:279, SEQ ID NO:280, SEQ ID NO:281, SEQ ID NO:282, SEQ ID NO:283, SEQ ID NO:284, SEQ ID NO:285, SEQ ID NO:286, SEQ ID NO:287, SEQ ID NO:288, SEQ ID NO:289, SEQ ID NO:290, SEQ ID NO:291, SEQ ID NO:292, SEQ ID NO:293, SEQ ID NO:294, SEQ ID NO:295, SEQ ID NO:296, SEQ ID NO:297, SEQ ID NO:298, SEQ ID NO:299, SEQ ID NO:300, SEQ ID NO:301, SEQ ID NO:302, SEQ ID NO:303, SEQ ID NO:304, SEQ ID NO:305, SEQ ID NO:306, SEQ ID NO:307, SEQ ID NO:308, SEQ ID NO:309, SEQ ID NO:310, SEQ ID NO:311, SEQ ID NO:312, SEQ ID NO:313, SEQ ID NO:314, SEQ ID NO:315, SEQ ID NO:316, SEQ ID NO:317, SEQ ID NO:318, SEQ ID NO:319, SEQ ID NO:320, SEQ ID NO:321, SEQ ID NO:322, SEQ ID NO:323, SEQ ID NO:324, SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:2697, SEQ ID NO:2645, SEQ ID NO:2707, SEQ ID NO:2679, SEQ ID NO:2717, SEQ ID NO:2646, SEQ ID NO:2667, SEQ ID NO:2706, SEQ ID NO:2740, SEQ ID NO:2669, SEQ ID NO:2674, SEQ ID NO:2743, SEQ ID NO:2716, SEQ ID NO:2727, SEQ ID NO:2721, SEQ ID NO:2641, SEQ ID NO:2671, SEQ ID NO:2752, SEQ ID NO:2737, SEQ ID NO:2719, SEQ ID NO:2684, SEQ ID NO:2677, SEQ ID NO:2748, SEQ ID NO:2703, SEQ ID NO:2711, SEQ ID NO:2663, SEQ ID NO:2657, SEQ ID NO:2683, SEQ ID NO:2686, SEQ ID NO:2687, SEQ ID NO:2644, SEQ ID NO:2664, SEQ ID NO:2747, SEQ ID NO:2744, SEQ ID NO:2678, SEQ ID NO:2731, SEQ ID NO:2713, SEQ ID NO:2736, SEQ ID NO:2708, SEQ ID NO:2670, SEQ ID NO:2661, SEQ ID NO:2680, SEQ ID NO:2754, SEQ ID NO:2728, SEQ ID NO:2742, SEQ ID NO:2668, SEQ ID NO:2750, SEQ ID NO:2746, SEQ ID NO:2738, SEQ ID NO:2627, SEQ ID NO:2739, SEQ ID NO:2647, SEQ ID NO:2628, SEQ ID NO:2638, SEQ ID NO:2725, SEQ ID NO:2714, SEQ ID NO:2635, SEQ ID NO:2751, SEQ ID NO:2629, SEQ ID NO:2695, SEQ ID NO:2741, SEQ ID NO:2691, SEQ ID NO:2726, SEQ ID NO:2722, SEQ ID NO:2689, SEQ ID NO:2734, SEQ ID NO:2631, SEQ ID NO:2656, SEQ ID NO:2696, SEQ ID NO:2676, SEQ ID NO:2701, SEQ ID NO:2730, SEQ ID NO:2710, SEQ ID NO:2632, SEQ ID NO:2724, SEQ ID NO:2698, SEQ ID NO:2662, SEQ ID NO:2753, SEQ ID NO:2704, SEQ ID NO:2675, SEQ ID NO:2700, SEQ ID NO:2640, SEQ ID NO:2723, SEQ ID NO:2658, SEQ ID NO:2688, SEQ ID NO:2735, SEQ ID NO:2702, SEQ ID NO:2681, SEQ ID NO:2755, SEQ ID NO:2715, SEQ ID NO:2732, SEQ ID NO:2652, SEQ ID NO:2651, SEQ ID NO:2718, SEQ ID NO:2673, SEQ ID NO:2733, SEQ ID NO:2712, SEQ ID NO:2659, SEQ ID NO:2654, SEQ ID NO:2636, SEQ ID NO:2639, SEQ ID NO:2690, SEQ ID NO:2705, SEQ ID NO:2685, SEQ ID NO:2692, SEQ ID NO:2693, SEQ ID NO:2648, SEQ ID NO:2650, SEQ ID NO:2720, SEQ ID NO:2660, SEQ ID NO:2666, SEQ ID NO:2699, SEQ ID NO:2633, SEQ ID NO:2672, SEQ ID NO:2642, SEQ ID NO:2682, SEQ ID NO:2655, SEQ ID NO:2630, SEQ ID NO:2745, SEQ ID NO:2643, SEQ ID NO:2694, SEQ ID NO:2749, SEQ ID NO:2665, SEQ ID NO:2649, SEQ ID NO:2637, SEQ ID NO:2634, SEQ ID NO:2709, SEQ ID NO:2653, SEQ ID NO:2729. In one variation, the invention is further directed to detecting the expression level of one or more additional genes in the patient to diagnose or monitor transplant rejection in the patient, wherein the one or more additional genes include a nucleotide sequence selected from SEQ ID NO:8, SEQ ID NO:75, SEQ ID NO:76, SEQ ID NO:77, SEQ ID NO:78, SEQ ID NO:79, SEQ ID NO:80, SEQ ID NO:81, SEQ ID NO:89, SEQ ID NO:97, SEQ ID NO:99, SEQ ID NO:100, SEQ ID NO:110, SEQ ID NO:111, SEQ ID NO:112, SEQ ID NO:113, SEQ ID NO:140, SEQ ID NO:141, SEQ ID NO:142, SEQ ID NO:143, SEQ ID NO:144, SEQ ID NO:145, SEQ ID NO:146, SEQ ID NO:147, SEQ ID NO:148, SEQ ID NO:149, SEQ ID NO:150, SEQ ID NO:15.

In a further variation, the invention is directed to a method of diagnosing or monitoring cardiac transplant rejection in a patient by detecting the expression level of one or more genes in the patient to diagnose or monitor cardiac transplant rejection in the patient wherein the one or more genes include a nucleotide sequence selected from SEQ ID NO:2, SEQ ID NO:3, SEQ ID NO:4, SEQ ID NO:5, SEQ ID NO:6, SEQ ID NO:7, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:173, SEQ ID NO:174, SEQ ID NO:175, SEQ ID NO:176, SEQ ID NO:177, SEQ ID NO:178, SEQ ID NO:179, SEQ ID NO:180, SEQ ID NO:181, SEQ ID NO:182, SEQ ID NO:183, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, SEQ ID NO:217, SEQ ID NO:218, SEQ ID NO:219, SEQ ID NO:220, SEQ ID NO:221, SEQ ID NO:222, SEQ ID NO:223, SEQ ID NO:224, SEQ ID NO:225, SEQ ID NO:226, SEQ ID NO:227, SEQ ID NO:228, SEQ ID NO:229, SEQ ID NO:230, SEQ ID NO:231, SEQ ID NO:232, SEQ ID NO:233, SEQ ID NO:234, SEQ ID NO:235, SEQ ID NO:236, SEQ ID NO:237, SEQ ID NO:238, SEQ ID NO:239, SEQ ID NO:240, SEQ ID NO:241, SEQ ID NO:242, SEQ ID NO:243, SEQ ID NO:244, SEQ ID NO:245, SEQ ID NO:246, SEQ ID NO:247, SEQ ID NO:248, SEQ ID NO:249, SEQ ID NO:250, SEQ ID NO:251, SEQ ID NO:252, SEQ ID NO:253, SEQ ID NO:254, SEQ ID NO:255, SEQ ID NO:256, SEQ ID NO:257, SEQ ID NO:258, SEQ ID NO:259, SEQ ID NO:260, SEQ ID NO:261, SEQ ID NO:262, SEQ ID NO:263, SEQ ID NO:264, SEQ ID NO:265, SEQ ID NO:266, SEQ ID NO:267, SEQ ID NO:268, SEQ ID NO:269, SEQ ID NO:270, SEQ ID NO:271, SEQ ID NO:272, SEQ ID NO:273, SEQ ID NO:274, SEQ ID NO:275, SEQ ID NO:276, SEQ ID NO:277, SEQ ID NO:278, SEQ ID NO:279, SEQ ID NO:280, SEQ ID NO:281, SEQ ID NO:282, SEQ ID NO:283, SEQ ID NO:284, SEQ ID NO:285, SEQ ID NO:286, SEQ ID NO:287, SEQ ID NO:288, SEQ ID NO:289, SEQ ID NO:290, SEQ ID NO:291, SEQ ID NO:292, SEQ ID NO:293, SEQ ID NO:294, SEQ ID NO:295, SEQ ID NO:296, SEQ ID NO:297, SEQ ID NO:298, SEQ ID NO:299, SEQ ID NO:300, SEQ ID NO:301, SEQ ID NO:302, SEQ ID NO:303, SEQ ID NO:304, SEQ ID NO:305, SEQ ID NO:306, SEQ ID NO:307, SEQ ID NO:308, SEQ ID NO:309, SEQ ID NO:310, SEQ ID NO:311, SEQ ID NO:312, SEQ ID NO:313, SEQ ID NO:314, SEQ ID NO:315, SEQ ID NO:316, SEQ ID NO:317, SEQ ID NO:318, SEQ ID NO:319, SEQ ID NO:320, SEQ ID NO:321, SEQ ID NO:322, SEQ ID NO:323, SEQ ID NO:324, SEQ ID NO:325, SEQ ID NO:326, SEQ ID NO:327, SEQ ID NO:328, SEQ ID NO:329, SEQ ID NO:330, SEQ ID NO:331, SEQ ID NO:332. In one variation, the method includes detecting the expression level of one or more additional genes in the patient to diagnose or monitor cardiac transplant rejection in the patient, wherein the one or more additional genes include a nucleotide sequence selected from SEQ ID NO:8, SEQ ID NO:76, SEQ ID NO:77, SEQ ID NO:78, SEQ ID NO:79, SEQ ID NO:97, SEQ ID NO:140, SEQ ID NO:141, SEQ ID NO:142, SEQ ID NO:143, SEQ ID NO:144, SEQ ID NO:145, SEQ ID NO:146, SEQ ID NO:147, SEQ ID NO:148, SEQ ID NO:149, SEQ ID NO:150, SEQ ID NO:151.

The invention is also directed to a method of diagnosing or monitoring kidney transplant rejection in a patient by detecting the expression level of one or more genes in the patient to diagnose or monitor kidney transplant rejection in the patient wherein the one or more genes include a nucleotide sequence selected from SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:78, SEQ ID NO:82, SEQ ID NO:83, SEQ ID NO:84, SEQ ID NO:85, SEQ ID NO:86, SEQ ID NO:87, SEQ ID NO:88, SEQ ID NO:90, SEQ ID NO:91, SEQ ID NO:92, SEQ ID NO:93, SEQ ID NO:94, SEQ ID NO:95, SEQ ID NO:96, SEQ ID NO:97, SEQ ID NO:98, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:173, SEQ ID NO:174, SEQ ID NO:175, SEQ ID NO:176, SEQ ID NO:177, SEQ ID NO:178, SEQ ID NO:179, SEQ ID NO:180, SEQ ID NO:181, SEQ ID NO:182, SEQ ID NO:183, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, SEQ ID NO:217, SEQ ID NO:218, SEQ ID NO:219, SEQ ID NO:220, SEQ ID NO:221, SEQ ID NO:222, SEQ ID NO:223, SEQ ID NO:224, SEQ ID NO:225, SEQ ID NO:226, SEQ ID NO:227, SEQ ID NO:228, SEQ ID NO:229, SEQ ID NO:230, SEQ ID NO:231, SEQ ID NO:232, SEQ ID NO:233, SEQ ID NO:234, SEQ ID NO:235, SEQ ID NO:236, SEQ ID NO:237, SEQ ID NO:238, SEQ ID NO:239, SEQ ID NO:240, SEQ ID NO:241, SEQ ID NO:242, SEQ ID NO:243, SEQ ID NO:244, SEQ ID NO:245, SEQ ID NO:246, SEQ ID NO:247, SEQ ID NO:248, SEQ ID NO:249, SEQ ID NO:250, SEQ ID NO:251, SEQ ID NO:252, SEQ ID NO:253, SEQ ID NO:254, SEQ ID NO:255, SEQ ID NO:256, SEQ ID NO:257, SEQ ID NO:258, SEQ ID NO:259, SEQ ID NO:260, SEQ ID NO:261, SEQ ID NO:262, SEQ ID NO:263, SEQ ID NO:264, SEQ ID NO:265, SEQ ID NO:266, SEQ ID NO:267, SEQ ID NO:268, SEQ ID NO:269, SEQ ID NO:270, SEQ ID NO:271, SEQ ID NO:272, SEQ ID NO:273, SEQ ID NO:274, SEQ ID NO:275, SEQ ID NO:276, SEQ ID NO:277, SEQ ID NO:278, SEQ ID NO:279, SEQ ID NO:280, SEQ ID NO:281, SEQ ID NO:282, SEQ ID NO:283, SEQ ID NO:284, SEQ ID NO:285, SEQ ID NO:286, SEQ ID NO:287, SEQ ID NO:288, SEQ ID NO:289, SEQ ID NO:290, SEQ ID NO:291, SEQ ID NO:292, SEQ ID NO:293, SEQ ID NO:294, SEQ ID NO:295, SEQ ID NO:296, SEQ ID NO:297, SEQ ID NO:298, SEQ ID NO:299, SEQ ID NO:300, SEQ ID NO:301, SEQ ID NO:302, SEQ ID NO:303, SEQ ID NO:304, SEQ ID NO:305, SEQ ID NO:306, SEQ ID NO:307, SEQ ID NO:308, SEQ ID NO:309, SEQ ID NO:310, SEQ ID NO:311, SEQ ID NO:312, SEQ ID NO:313, SEQ ID NO:314, SEQ ID NO:315, SEQ ID NO:316, SEQ ID NO:317, SEQ ID NO:318, SEQ ID NO:319, SEQ ID NO:320, SEQ ID NO:321, SEQ ID NO:322, SEQ ID NO:323, SEQ ID NO:324, SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:2697, SEQ ID NO:2645, SEQ ID NO:2707, SEQ ID NO:2679, SEQ ID NO:2717, SEQ ID NO:2646, SEQ ID NO:2667, SEQ ID NO:2706, SEQ ID NO:2740, SEQ ID NO:2669, SEQ ID NO:2674, SEQ ID NO:2743, SEQ ID NO:2716, SEQ ID NO:2727, SEQ ID NO:2721, SEQ ID NO:2641, SEQ ID NO:2671, SEQ ID NO:2752, SEQ ID NO:2737, SEQ ID NO:2719, SEQ ID NO:2684, SEQ ID NO:2677, SEQ ID NO:2748, SEQ ID NO:2703, SEQ ID NO:2711, SEQ ID NO:2663, SEQ ID NO:2657, SEQ ID NO:2683, SEQ ID NO:2686, SEQ ID NO:2687, SEQ ID NO:2644, SEQ ID NO:2664, SEQ ID NO:2747, SEQ ID NO:2744, SEQ ID NO:2678, SEQ ID NO:2731, SEQ ID NO:2713, SEQ ID NO:2736, SEQ ID NO:2708, SEQ ID NO:2670, SEQ ID NO:2661, SEQ ID NO:2680, SEQ ID NO:2754, SEQ ID NO:2728, SEQ ID NO:2742, SEQ ID NO:2668, SEQ ID NO:2750, SEQ ID NO:2746, SEQ ID NO:2738, SEQ ID NO:2627, SEQ ID NO:2739, SEQ ID NO:2647, SEQ ID NO:2628, SEQ ID NO:2638, SEQ ID NO:2725, SEQ ID NO:2714, SEQ ID NO:2635, SEQ ID NO:2751, SEQ ID NO:2629, SEQ ID NO:2695, SEQ ID NO:2741, SEQ ID NO:2691, SEQ ID NO:2726, SEQ ID NO:2722, SEQ ID NO:2689, SEQ ID NO:2734, SEQ ID NO:2631, SEQ ID NO:2656, SEQ ID NO:2696, SEQ ID NO:2676, SEQ ID NO:2701, SEQ ID NO:2730, SEQ ID NO:2710, SEQ ID
NO:2632, SEQ ID NO:2724, SEQ ID NO:2698, SEQ ID
NO:2662, SEQ ID NO:2753, SEQ ID NO:2704, SEQ ID
NO:2675, SEQ ID NO:2700, SEQ ID NO:2640, SEQ ID
NO:2723, SEQ ID NO:2658, SEQ ID NO:2688, SEQ ID
NO:2735, SEQ ID NO:2702, SEQ ID NO:2681, SEQ ID
NO:2755, SEQ ID NO:2715, SEQ ID NO:2732, SEQ ID
NO:2652, SEQ ID NO:2651, SEQ ID NO:2718, SEQ ID
NO:2673, SEQ ID NO:2733, SEQ ID NO:2712, SEQ ID
NO:2659, SEQ ID NO:2654, SEQ ID NO:2636, SEQ ID
NO:2639, SEQ ID NO:2690, SEQ ID NO:2705, SEQ ID
NO:2685, SEQ ID NO:2692, SEQ ID NO:2693, SEQ ID
NO:2648, SEQ ID NO:2650, SEQ ID NO:2720, SEQ ID
NO:2660, SEQ ID NO:2666, SEQ ID NO:2699, SEQ ID
NO:2633, SEQ ID NO:2672, SEQ ID NO:2642, SEQ ID
NO:2682, SEQ ID NO:2655, SEQ ID NO:2630, SEQ ID
NO:2745, SEQ ID NO:2643, SEQ ID NO:2694, SEQ ID
NO:2749, SEQ ID NO:2665, SEQ ID NO:2649, SEQ ID
NO:2637, SEQ ID NO:2634, SEQ ID NO:2709, SEQ ID
NO:2653, SEQ ID NO:2729. In one variation, the method further includes detecting the expression level of one or more additional genes in the patient to diagnose or monitor kidney transplant rejection in a patient, wherein the one or more additional genes includes a nucleotide sequence selected from SEQ ID NO: 75, SEQ ID NO:76, SEQ ID NO:77, SEQ ID NO:79, SEQ ID NO:80, SEQ ID NO:81, SEQ ID NO:89, SEQ ID NO:99, SEQ ID NO:100, SEQ ID NO:110, SEQ ID NO:111, SEQ ID NO:112, SEQ ID NO:113, SEQ ID NO:140, SEQ ID NO:141, SEQ ID NO:142, SEQ ID NO:143, SEQ ID NO:144, SEQ ID NO:145, SEQ ID NO:146, SEQ ID NO:147, SEQ ID NO:148, SEQ ID NO:149, SEQ ID NO:150, SEQ ID NO:151.

In another aspect, the methods of diagnosing or monitoring transplant rejection include detecting the expression level of at least two of the genes. In another variation, methods of diagnosing or monitoring transplant rejection include detecting the expression level of at least ten of the genes. In a further variation, the methods of diagnosing or monitoring transplant rejection include detecting the expression level of at least one hundred of the genes. In still a further variation, the methods of diagnosing or monitoring transplant rejection include detecting the expression level of all the listed genes.

In another variation, transplant rejection may be selected from heart transplant rejection, kidney transplant rejection, liver transplant rejection, pancreas transplant rejection, pancreatic islet transplant rejection, lung transplant rejection, bone marrow transplant rejection, stem cell transplant rejection, xenotransplant rejection, and mechanical organ replacement rejection.

In another aspect, the methods of detecting transplant rejection include detecting the expression level by measuring the RNA level expressed by one or more genes. The method may further including isolating RNA from the patient prior to detecting the RNA level expressed by the one or more genes.

In one variation, the RNA level is detected by PCR. In a still further variation, the PCR uses primers consisting of nucleotide sequences selected from the group consisting of SEQ ID NO:665, SEQ ID NO:666, SEQ ID NO:667, SEQ ID NO:668, SEQ ID NO:669, SEQ ID NO:670, SEQ ID NO:671, SEQ ID NO:672, SEQ ID NO:673, SEQ ID NO:674, SEQ ID NO:675, SEQ ID NO:676, SEQ ID NO:677, SEQ ID NO:678, SEQ ID NO:679, SEQ ID NO:680, SEQ ID NO:681, SEQ ID NO:682, SEQ ID NO:683, SEQ ID NO:684, SEQ ID NO:685, SEQ ID NO:686, SEQ ID NO:687, SEQ ID NO:688, SEQ ID NO:689, SEQ ID NO:690, SEQ ID NO:691, SEQ ID NO:692, SEQ ID NO:693, SEQ ID NO:694, SEQ ID NO:695, SEQ ID NO:696, SEQ ID NO:697, SEQ ID NO:698, SEQ ID NO:699, SEQ ID NO:700, SEQ ID NO:701, SEQ ID NO:702, SEQ ID NO:703, SEQ ID NO:704, SEQ ID NO:705, SEQ ID NO:706, SEQ ID NO:707, SEQ ID NO:708, SEQ ID NO:709, SEQ ID NO:710, SEQ ID NO:711, SEQ ID NO:712, SEQ ID NO:713, SEQ ID NO:714, SEQ ID NO:715, SEQ ID NO:716, SEQ ID NO:717, SEQ ID NO:718, SEQ ID NO:719, SEQ ID NO:720, SEQ ID NO:721, SEQ ID NO:722, SEQ ID NO:723, SEQ ID NO:724, SEQ ID NO:725, SEQ ID NO:726, SEQ ID NO:727, SEQ ID NO:728, SEQ ID NO:729, SEQ ID NO:730, SEQ ID NO:731, SEQ ID NO:732, SEQ ID NO:733, SEQ ID NO:734, SEQ ID NO:735, SEQ ID NO:736, SEQ ID NO:737, SEQ ID NO:738, SEQ ID NO:739, SEQ ID NO:740, SEQ ID NO:741, SEQ ID NO:742, SEQ ID NO:743, SEQ ID NO:744, SEQ ID NO:745, SEQ ID NO:746, SEQ ID NO:747, SEQ ID NO:748, SEQ ID NO:749, SEQ ID NO:750, SEQ ID NO:751, SEQ ID NO:752, SEQ ID NO:753, SEQ ID NO:754, SEQ ID NO:755, SEQ ID NO:756, SEQ ID NO:757, SEQ ID NO:758, SEQ ID NO:759, SEQ ID NO:760, SEQ ID NO:761, SEQ ID NO:762, SEQ ID NO:763, SEQ ID NO:764, SEQ ID NO:765, SEQ ID NO:766, SEQ ID NO:767, SEQ ID NO:768, SEQ ID NO:769, SEQ ID NO:770, SEQ ID NO:771, SEQ ID NO:772, SEQ ID NO:773, SEQ ID NO:774, SEQ ID NO:775, SEQ ID NO:776, SEQ ID NO:777, SEQ ID NO:778, SEQ ID NO:779, SEQ ID NO:780, SEQ ID NO:781, SEQ ID NO:782, SEQ ID NO:783, SEQ ID NO:784, SEQ ID NO:785, SEQ ID NO:786, SEQ ID NO:787, SEQ ID NO:788, SEQ ID NO:789, SEQ ID NO:790, SEQ ID NO:791, SEQ ID NO:792, SEQ ID NO:793, SEQ ID NO:794, SEQ ID NO:795, SEQ ID NO:796, SEQ ID NO:797, SEQ ID NO:798, SEQ ID NO:799, SEQ ID NO:800, SEQ ID NO:801, SEQ ID NO:802, SEQ ID NO:803, SEQ ID NO:804, SEQ ID NO:805, SEQ ID NO:806, SEQ ID NO:807, SEQ ID NO:808, SEQ ID NO:809, SEQ ID NO:810, SEQ ID NO:811, SEQ ID NO:812, SEQ ID NO:813, SEQ ID NO:814, SEQ ID NO:815, SEQ ID NO:816, SEQ ID NO:817, SEQ ID NO:818, SEQ ID NO:819, SEQ ID NO:820, SEQ ID NO:821, SEQ ID NO:822, SEQ ID NO:823, SEQ ID NO:824, SEQ ID NO:825, SEQ ID NO:826, SEQ ID NO:827, SEQ ID NO:828, SEQ ID NO:829, SEQ ID NO:830, SEQ ID NO:831, SEQ ID NO:832, SEQ ID NO:833, SEQ ID NO:834, SEQ ID NO:835, SEQ ID NO:836, SEQ ID NO:837, SEQ ID NO:838, SEQ ID NO:839, SEQ ID NO:840, SEQ ID NO:841, SEQ ID NO:842, SEQ ID NO:843, SEQ ID NO:844, SEQ ID NO:845, SEQ ID NO:846, SEQ ID NO:847, SEQ ID NO:848, SEQ ID NO:849, SEQ ID NO:850, SEQ ID NO:851, SEQ ID NO:852, SEQ ID NO:853, SEQ ID NO:854, SEQ ID NO:855, SEQ ID NO:856, SEQ ID NO:857, SEQ ID NO:858, SEQ ID NO:859, SEQ ID NO:860, SEQ ID NO:861, SEQ ID NO:862, SEQ ID NO:863, SEQ ID NO:864, SEQ ID NO:865, SEQ ID NO:866, SEQ ID NO:867, SEQ ID NO:868, SEQ ID NO:869, SEQ ID NO:870, SEQ ID NO:871, SEQ ID NO:872, SEQ ID NO:873, SEQ ID NO:874, SEQ ID NO:875, SEQ ID NO:876, SEQ ID NO:877, SEQ ID NO:878, SEQ ID NO:879, SEQ ID NO:880, SEQ ID NO:881, SEQ ID NO:882, SEQ ID NO:883, SEQ ID NO:884, SEQ ID NO:885, SEQ ID NO:886, SEQ ID NO:887, SEQ ID NO:888, SEQ ID NO:889, SEQ ID NO:890, SEQ ID NO:891, SEQ ID NO:892, SEQ ID NO:893, SEQ ID NO:894, SEQ ID NO:895, SEQ ID NO:896, SEQ ID NO:897, SEQ ID NO:898, SEQ ID
NO:899, SEQ ID NO:900, SEQ ID NO:901, SEQ ID
NO:902, SEQ ID NO:903, SEQ ID NO:904, SEQ ID
NO:905, SEQ ID NO:906, SEQ ID NO:907, SEQ ID
NO:908, SEQ ID NO:909, SEQ ID NO:910, SEQ ID
NO:911, SEQ ID NO:912, SEQ ID NO:913, SEQ ID
NO:914, SEQ ID NO:915, SEQ ID NO:916, SEQ ID
NO:917, SEQ ID NO:918, SEQ ID NO:919, SEQ ID
NO:920, SEQ ID NO:921, SEQ ID NO:922, SEQ ID
NO:923, SEQ ID NO:924, SEQ ID NO:925, SEQ ID
NO:926, SEQ ID NO:927, SEQ ID NO:928, SEQ ID
NO:929, SEQ ID NO:930, SEQ ID NO:931, SEQ ID
NO:932, SEQ ID NO:933, SEQ ID NO:934, SEQ ID
NO:935, SEQ ID NO:936, SEQ ID NO:937, SEQ ID
NO:938, SEQ ID NO:939, SEQ ID NO:940, SEQ ID
NO:941, SEQ ID NO:942, SEQ ID NO:943, SEQ ID
NO:944, SEQ ID NO:945, SEQ ID NO:946, SEQ ID
NO:947, SEQ ID NO:948, SEQ ID NO:949, SEQ ID
NO:950, SEQ ID NO:951, SEQ ID NO:952, SEQ ID
NO:953, SEQ ID NO:954, SEQ ID NO:955, SEQ ID
NO:956, SEQ ID NO:957, SEQ ID NO:958, SEQ ID
NO:959, SEQ ID NO:960, SEQ ID NO:961, SEQ ID
NO:962, SEQ ID NO:963, SEQ ID NO:964, SEQ ID
NO:965, SEQ ID NO:966, SEQ ID NO:967, SEQ ID
NO:968, SEQ ID NO:969, SEQ ID NO:970, SEQ ID
NO:971, SEQ ID NO:972, SEQ ID NO:973, SEQ ID
NO:974, SEQ ID NO:975, SEQ ID NO:976, SEQ ID
NO:977, SEQ ID NO:978, SEQ ID NO:979, SEQ ID
NO:980, SEQ ID NO:981, SEQ ID NO:982, SEQ ID
NO:983, SEQ ID NO:984, SEQ ID NO:985, SEQ ID
NO:986, SEQ ID NO:987, SEQ ID NO:988, SEQ ID
NO:989, SEQ ID NO:990, SEQ ID NO:991, SEQ ID
NO:992, SEQ ID NO:993, SEQ ID NO:994, SEQ ID
NO:995, SEQ ID NO:996, SEQ ID NO:997, SEQ ID
NO:998, SEQ ID NO:999, SEQ ID NO:1000, SEQ ID
NO:1001, SEQ ID NO:1002, SEQ ID NO:1003, SEQ ID
NO:1004, SEQ ID NO:1005, SEQ ID NO:1006, SEQ ID
NO:1007, SEQ ID NO:1008, SEQ ID NO:1009, SEQ ID
NO:1010, SEQ ID NO:1011, SEQ ID NO:1012, SEQ ID
NO:1013, SEQ ID NO:1014, SEQ ID NO:1015, SEQ ID
NO:1016, SEQ ID NO:1017, SEQ ID NO:1018, SEQ ID
NO:1019, SEQ ID NO:1020, SEQ ID NO:1021, SEQ ID
NO:1022, SEQ ID NO:1023, SEQ ID NO:1024, SEQ ID
NO:1025, SEQ ID NO:1026, SEQ ID NO:1027, SEQ ID
NO:1028, SEQ ID NO:1029, SEQ ID NO:1030, SEQ ID
NO:1031, SEQ ID NO:1032, SEQ ID NO:1033, SEQ ID
NO:1034, SEQ ID NO:1035, SEQ ID NO:1036, SEQ ID
NO:1037, SEQ ID NO:1038, SEQ ID NO:1039, SEQ ID
NO:1040, SEQ ID NO:1041, SEQ ID NO:1042, SEQ ID
NO:1043, SEQ ID NO:1044, SEQ ID NO:1045, SEQ ID
NO:1046, SEQ ID NO:1047, SEQ ID NO:1048, SEQ ID
NO:1049, SEQ ID NO:1050, SEQ ID NO:1051, SEQ ID
NO:1052, SEQ ID NO:1053, SEQ ID NO:1054, SEQ ID
NO:1055, SEQ ID NO:1056, SEQ ID NO:1057, SEQ ID
NO:1058, SEQ ID NO:1059, SEQ ID NO:1060, SEQ ID
NO:1061, SEQ ID NO:1062, SEQ ID NO:1063, SEQ ID
NO:1064, SEQ ID NO:1065, SEQ ID NO:1066, SEQ ID
NO:1067, SEQ ID NO:1068, SEQ ID NO:1069, SEQ ID
NO:1070, SEQ ID NO:1071, SEQ ID NO:1072, SEQ ID
NO:1073, SEQ ID NO:1074, SEQ ID NO:1075, SEQ ID
NO:1076, SEQ ID NO:1077, SEQ ID NO:1078, SEQ ID
NO:1079, SEQ ID NO:1080, SEQ ID NO:1081, SEQ ID
NO:1082, SEQ ID NO:1083, SEQ ID NO:1084, SEQ ID
NO:1085, SEQ ID NO:1086, SEQ ID NO:1087, SEQ ID
NO:1088, SEQ ID NO:1089, SEQ ID NO:1090, SEQ ID
NO:1091, SEQ ID NO:1092, SEQ ID NO:1093, SEQ ID
NO:1094, SEQ ID NO:1095, SEQ ID NO:1096, SEQ ID
NO:1097, SEQ ID NO:1098, SEQ ID NO:1099, SEQ ID
NO:1100, SEQ ID NO:1101, SEQ ID NO:1102, SEQ ID
NO:1103, SEQ ID NO:1104, SEQ ID NO:1105, SEQ ID
NO:1106, SEQ ID NO:1107, SEQ ID NO:1108, SEQ ID
NO:1109, SEQ ID NO:1110, SEQ ID NO:1111, SEQ ID
NO:1112, SEQ ID NO:1113, SEQ ID NO:1114, SEQ ID
NO:1115, SEQ ID NO:1116, SEQ ID NO:1117, SEQ ID
NO:1118, SEQ ID NO:1119, SEQ ID NO:1120, SEQ ID
NO:1121, SEQ ID NO:1122, SEQ ID NO:1123, SEQ ID
NO:1124, SEQ ID NO:1125, SEQ ID NO:1126, SEQ ID
NO:1127, SEQ ID NO:1128, SEQ ID NO:1129, SEQ ID
NO:1130, SEQ ID NO:1131, SEQ ID NO:1132, SEQ ID
NO:1133, SEQ ID NO:1134, SEQ ID NO:1135, SEQ ID
NO:1136, SEQ ID NO:1137, SEQ ID NO:1138, SEQ ID
NO:1139, SEQ ID NO:1140, SEQ ID NO:1141, SEQ ID
NO:1142, SEQ ID NO:1143, SEQ ID NO:1144, SEQ ID
NO:1145, SEQ ID NO:1146, SEQ ID NO:1147, SEQ ID
NO:1148, SEQ ID NO:1149, SEQ ID NO:1150, SEQ ID
NO:1151, SEQ ID NO:1152, SEQ ID NO:1153, SEQ ID
NO:1154, SEQ ID NO:1155, SEQ ID NO:1156, SEQ ID
NO:1157, SEQ ID NO:1158, SEQ ID NO:1159, SEQ ID
NO:1160, SEQ ID NO:1161, SEQ ID NO:1162, SEQ ID
NO:1163, SEQ ID NO:1164, SEQ ID NO:1165, SEQ ID
NO:1166, SEQ ID NO:1167, SEQ ID NO:1168, SEQ ID
NO:1169, SEQ ID NO:1170, SEQ ID NO:1171, SEQ ID
NO:1172, SEQ ID NO:1173, SEQ ID NO:1174, SEQ ID
NO:1175, SEQ ID NO:1176, SEQ ID NO:1177, SEQ ID
NO:1178, SEQ ID NO:1179, SEQ ID NO:1180, SEQ ID
NO:1181, SEQ ID NO:1182, SEQ ID NO:1183, SEQ ID
NO:1184, SEQ ID NO:1185, SEQ ID NO:1186, SEQ ID
NO:1187, SEQ ID NO:1188, SEQ ID NO:1189, SEQ ID
NO:1190, SEQ ID NO:1191, SEQ ID NO:1192, SEQ ID
NO:1193, SEQ ID NO:1194, SEQ ID NO:1195, SEQ ID
NO:1196, SEQ ID NO:1197, SEQ ID NO:1198, SEQ ID
NO:1199, SEQ ID NO:1200, SEQ ID NO:1201, SEQ ID
NO:1202, SEQ ID NO:1203, SEQ ID NO:1204, SEQ ID
NO:1205, SEQ ID NO:1206, SEQ ID NO:1207, SEQ ID
NO:1208, SEQ ID NO:1209, SEQ ID NO:1210, SEQ ID
NO:1211, SEQ ID NO:1212, SEQ ID NO:1213, SEQ ID
NO:1214, SEQ ID NO:1215, SEQ ID NO:1216, SEQ ID
NO:1217, SEQ ID NO:1218, SEQ ID NO:1219, SEQ ID
NO:1220, SEQ ID NO:1221, SEQ ID NO:1222, SEQ ID
NO:1223, SEQ ID NO:1224, SEQ ID NO:1225, SEQ ID
NO:1226, SEQ ID NO:1227, SEQ ID NO:1228, SEQ ID
NO:1229, SEQ ID NO:1230, SEQ ID NO:1231, SEQ ID
NO:1232, SEQ ID NO:1233, SEQ ID NO:1234, SEQ ID
NO:1235, SEQ ID NO:1236, SEQ ID NO:1237, SEQ ID
NO:1238, SEQ ID NO:1239, SEQ ID NO:1240, SEQ ID
NO:1241, SEQ ID NO:1242, SEQ ID NO:1243, SEQ ID
NO:1244, SEQ ID NO:1245, SEQ ID NO:1246, SEQ ID
NO:1247, SEQ ID NO:1248, SEQ ID NO:1249, SEQ ID
NO:1250, SEQ ID NO:1251, SEQ ID NO:1252, SEQ ID
NO:1253, SEQ ID NO:1254, SEQ ID NO:1255, SEQ ID
NO:1256, SEQ ID NO:1257, SEQ ID NO:1258, SEQ ID
NO:1259, SEQ ID NO:1260, SEQ ID NO:1261, SEQ ID
NO:1262, SEQ ID NO:1263, SEQ ID NO:1264, SEQ ID
NO:1265, SEQ ID NO:1266, SEQ ID NO:1267, SEQ ID
NO:1268, SEQ ID NO:1269, SEQ ID NO:1270, SEQ ID
NO:1271, SEQ ID NO:1272, SEQ ID NO:1273, SEQ ID
NO:1274, SEQ ID NO:1275, SEQ ID NO:1276, SEQ ID
NO:1277, SEQ ID NO:1278, SEQ ID NO:1279, SEQ ID
NO:1280, SEQ ID NO:1281, SEQ ID NO:1282, SEQ ID
NO:1283, SEQ ID NO:1284, SEQ ID NO:1285, SEQ ID
NO:1286, SEQ ID NO:1287, SEQ ID NO:1288, SEQ ID
NO:1289, SEQ ID NO:1290, SEQ ID NO:1291, SEQ ID
NO:1292, SEQ ID NO:1293, SEQ ID NO:1294, SEQ ID
NO:1295, SEQ ID NO:1296, SEQ ID NO:1297, SEQ ID NO:1298, SEQ ID NO:1299, SEQ ID NO:1300, SEQ ID NO:1301, SEQ ID NO:1302, SEQ ID NO:1303, SEQ ID NO:1304, SEQ ID NO:1305, SEQ ID NO:1306, SEQ ID NO:1307, SEQ ID NO:1308, SEQ ID NO:1309, SEQ ID NO:1310, SEQ ID NO:1311, SEQ ID NO:1312, SEQ ID NO:1313, SEQ ID NO:1314, SEQ ID NO:1315, SEQ ID NO:1316, SEQ ID NO:1317, SEQ ID NO:1318, SEQ ID NO:1319, SEQ ID NO:1320, SEQ ID NO:1321, SEQ ID NO:1322, SEQ ID NO:1323, SEQ ID NO:1324, SEQ ID NO:1325, SEQ ID NO:1326, SEQ ID NO:1656, SEQ ID NO:1657, SEQ ID NO:1658, SEQ ID NO:1659, SEQ ID NO:1660, SEQ ID NO:1661, SEQ ID NO:1662, SEQ ID NO:1663, SEQ ID NO:1664, SEQ ID NO:1665, SEQ ID NO:1666, SEQ ID NO:1667, SEQ ID NO:1668, SEQ ID NO:1669, SEQ ID NO:1670, SEQ ID NO:1671, SEQ ID NO:1672, SEQ ID NO:1673, SEQ ID NO:1674, SEQ ID NO:1675, SEQ ID NO:1676, SEQ ID NO:1677, SEQ ID NO:1678, SEQ ID NO:1679, SEQ ID NO:1680, SEQ ID NO:1681, SEQ ID NO:1682, SEQ ID NO:1683, SEQ ID NO:1684, SEQ ID NO:1685, SEQ ID NO:1686, SEQ ID NO:1687, SEQ ID NO:1688, SEQ ID NO:1689, SEQ ID NO:1690, SEQ ID NO:1691, SEQ ID NO:1692, SEQ ID NO:1693, SEQ ID NO:1694, SEQ ID NO:1695, SEQ ID NO:1696, SEQ ID NO:1697, SEQ ID NO:1698, SEQ ID NO:1699, SEQ ID NO:1700, SEQ ID NO:1701, SEQ ID NO:1702, SEQ ID NO:1703, SEQ ID NO:1704, SEQ ID NO:1705, SEQ ID NO:1706, SEQ ID NO:1707, SEQ ID NO:1708, SEQ ID NO:1709, SEQ ID NO:1710, SEQ ID NO:1711, SEQ ID NO:1712, SEQ ID NO:1713, SEQ ID NO:1714, SEQ ID NO:1715, SEQ ID NO:1716, SEQ ID NO:1717, SEQ ID NO:1718, SEQ ID NO:1719, SEQ ID NO:1720, SEQ ID NO:1721, SEQ ID NO:1722, SEQ ID NO:1723, SEQ ID NO:1724, SEQ ID NO:1725, SEQ ID NO:1726, SEQ ID NO:1727, SEQ ID NO:1728, SEQ ID NO:1729, SEQ ID NO:1730, SEQ ID NO:1731, SEQ ID NO:1732, SEQ ID NO:1733, SEQ ID NO:1734, SEQ ID NO:1735, SEQ ID NO:1736, SEQ ID NO:1737, SEQ ID NO:1738, SEQ ID NO:1739, SEQ ID NO:1740, SEQ ID NO:1741, SEQ ID NO:1742, SEQ ID NO:1743, SEQ ID NO:1744, SEQ ID NO:1745, SEQ ID NO:1746, SEQ ID NO:1747, SEQ ID NO:1748, SEQ ID NO:1749, SEQ ID NO:1750, SEQ ID NO:1751, SEQ ID NO:1752, SEQ ID NO:1753, SEQ ID NO:1754, SEQ ID NO:1755, SEQ ID NO:1756, SEQ ID NO:1757, SEQ ID NO:1758, SEQ ID NO:1759, SEQ ID NO:1760, SEQ ID NO:1761, SEQ ID NO:1762, SEQ ID NO:1763, SEQ ID NO:1764, SEQ ID NO:1765, SEQ ID NO:1766, SEQ ID NO:1767, SEQ ID NO:1768, SEQ ID NO:1769, SEQ ID NO:1770, SEQ ID NO:1771, SEQ ID NO:1772, SEQ ID NO:1773, SEQ ID NO:1774, SEQ ID NO:1775, SEQ ID NO:1776, SEQ ID NO:1777, SEQ ID NO:1778, SEQ ID NO:1779, SEQ ID NO:1780, SEQ ID NO:1781, SEQ ID NO:1782, SEQ ID NO:1783, SEQ ID NO:1784, SEQ ID NO:1785, SEQ ID NO:1786, SEQ ID NO:1787, SEQ ID NO:1788, SEQ ID NO:1789, SEQ ID NO:1790, SEQ ID NO:1791, SEQ ID NO:1792, SEQ ID NO:1793, SEQ ID NO:1794, SEQ ID NO:1795, SEQ ID NO:1796, SEQ ID NO:1797, SEQ ID NO:1798, SEQ ID NO:1799, SEQ ID NO:1800, SEQ ID NO:1801, SEQ ID NO:1802, SEQ ID NO:1803, SEQ ID NO:1804, SEQ ID NO:1805, SEQ ID NO:1806, SEQ ID NO:1807, SEQ ID NO:1808, SEQ ID NO:1809, SEQ ID NO:1810, SEQ ID NO:1811, SEQ ID NO:1812, SEQ ID NO:1813, SEQ ID NO:1814, SEQ ID NO:1815, SEQ ID NO:1816, SEQ ID NO:1817, SEQ ID NO:1818, SEQ ID NO:1819, SEQ ID NO:1820, SEQ ID NO:1821, SEQ ID NO:1822, SEQ ID NO:1823, SEQ ID NO:1824, SEQ ID NO:1825, SEQ ID NO:1826, SEQ ID NO:1827, SEQ ID NO:1828, SEQ ID NO:1829, SEQ ID NO:1830, SEQ ID NO:1831, SEQ ID NO:1832, SEQ ID NO:1833, SEQ ID NO:1834, SEQ ID NO:1835, SEQ ID NO:1836, SEQ ID NO:1837, SEQ ID NO:1838, SEQ ID NO:1839, SEQ ID NO:1840, SEQ ID NO:1841, SEQ ID NO:1842, SEQ ID NO:1843, SEQ ID NO:1844, SEQ ID NO:1845, SEQ ID NO:1846, SEQ ID NO:1847, SEQ ID NO:1848, SEQ ID NO:1849, SEQ ID NO:1850, SEQ ID NO:1851, SEQ ID NO:1852, SEQ ID NO:1853, SEQ ID NO:1854, SEQ ID NO:1855, SEQ ID NO:1856, SEQ ID NO:1857, SEQ ID NO:1858, SEQ ID NO:1859, SEQ ID NO:1860, SEQ ID NO:1861, SEQ ID NO:1862, SEQ ID NO:1863, SEQ ID NO:1864, SEQ ID NO:1865, SEQ ID NO:1866, SEQ ID NO:1867, SEQ ID NO:1868, SEQ ID NO:1869, SEQ ID NO:1870, SEQ ID NO:1871, SEQ ID NO:1872, SEQ ID NO:1873, SEQ ID NO:1874, SEQ ID NO:1875, SEQ ID NO:1876, SEQ ID NO:1877, SEQ ID NO:1878, SEQ ID NO:1879, SEQ ID NO:1880, SEQ ID NO:1881, SEQ ID NO:1882, SEQ ID NO:1883, SEQ ID NO:1884, SEQ ID NO:1885, SEQ ID NO:1886, SEQ ID NO:1887, SEQ ID NO:1888, SEQ ID NO:1889, SEQ ID NO:1890, SEQ ID NO:1891, SEQ ID NO:1892, SEQ ID NO:1893, SEQ ID NO:1894, SEQ ID NO:1895, SEQ ID NO:1896, SEQ ID NO:1897, SEQ ID NO:1898, SEQ ID NO:1899, SEQ ID NO:1900, SEQ ID NO:1901, SEQ ID NO:1902, SEQ ID NO:1903, SEQ ID NO:1904, SEQ ID NO:1905, SEQ ID NO:1906, SEQ ID NO:1907, SEQ ID NO:1908, SEQ ID NO:1909, SEQ ID NO:1910, SEQ ID NO:1911, SEQ ID NO:1912, SEQ ID NO:1913, SEQ ID NO:1914, SEQ ID NO:1915, SEQ ID NO:1916, SEQ ID NO:1917, SEQ ID NO:1918, SEQ ID NO:1919, SEQ ID NO:1920, SEQ ID NO:1921, SEQ ID NO:1922, SEQ ID NO:1923, SEQ ID NO:1924, SEQ ID NO:1925, SEQ ID NO:1926, SEQ ID NO:1927, SEQ ID NO:1928, SEQ ID NO:1929, SEQ ID NO:1930, SEQ ID NO:1931, SEQ ID NO:1932, SEQ ID NO:1933, SEQ ID NO:1934, SEQ ID NO:1935, SEQ ID NO:1936, SEQ ID NO:1937, SEQ ID NO:1938, SEQ ID NO:1939, SEQ ID NO:1940, SEQ ID NO:1941, SEQ ID NO:1942, SEQ ID NO:1943, SEQ ID NO:1944, SEQ ID NO:1945, SEQ ID NO:1946, SEQ ID NO:1947, SEQ ID NO:1948, SEQ ID NO:1949, SEQ ID NO:1950, SEQ ID NO:1951, SEQ ID NO:1952, SEQ ID NO:1953, SEQ ID NO:1954, SEQ ID NO:1955, SEQ ID NO:1956, SEQ ID NO:1957, SEQ ID NO:1958, SEQ ID NO:1959, SEQ ID NO:1960, SEQ ID NO:1961, SEQ ID NO:1962, SEQ ID NO:1963, SEQ ID NO:1964, SEQ ID NO:1965, SEQ ID NO:1966, SEQ ID NO:1967, SEQ ID NO:1968, SEQ ID NO:1969, SEQ ID NO:1970, SEQ ID NO:1971, SEQ ID NO:1972, SEQ ID NO:1973, SEQ ID NO:1974, SEQ ID NO:1975, SEQ ID NO:1976, SEQ ID NO:1977, SEQ ID NO:1978, SEQ ID NO:1979, SEQ ID NO:1980, SEQ ID NO:1981, SEQ ID NO:1982, SEQ ID NO:1983, SEQ ID NO:1984, SEQ ID NO:1985, SEQ ID NO:1986, SEQ ID NO:1987, SEQ ID NO:1988, SEQ ID NO:1989, SEQ ID NO:1990, SEQ ID NO:1991, SEQ ID NO:1992, SEQ ID NO:1993, SEQ ID NO:1994, SEQ ID NO:1995, SEQ ID NO:1996, SEQ ID NO:1997, SEQ ID NO:1998, SEQ ID NO:1999, SEQ ID NO:2000, SEQ ID NO:2001, SEQ ID NO:2002, SEQ ID NO:2003, SEQ ID NO:2004, SEQ ID NO:2005, SEQ ID NO:2006, SEQ ID NO:2007, SEQ ID NO:2008, SEQ ID NO:2009, SEQ ID NO:2010, SEQ ID NO:2011, SEQ ID NO:2012, SEQ ID NO:2013, SEQ ID NO:2014, SEQ ID NO:2015, SEQ ID NO:2016, SEQ ID NO:2017, SEQ ID NO:2018, SEQ ID NO:2019, SEQ ID NO:2020, SEQ ID NO:2021, SEQ ID NO:2022, SEQ ID NO:2023, SEQ ID NO:2024, SEQ ID NO:2025, SEQ ID NO:2026, SEQ ID NO:2027, SEQ ID NO:2028, SEQ ID NO:2029, SEQ ID NO:2030, SEQ ID NO:2031, SEQ ID NO:2032, SEQ ID NO:2033, SEQ ID NO:2034, SEQ ID NO:2035, SEQ ID NO:2036, SEQ ID NO:2037, SEQ ID NO:2038, SEQ ID NO:2039, SEQ ID NO:2040, SEQ ID NO:2041, SEQ ID NO:2042, SEQ ID NO:2043, SEQ ID NO:2044, SEQ ID NO:2045, SEQ ID NO:2046, SEQ ID NO:2047, SEQ ID NO:2048, SEQ ID NO:2049, SEQ ID NO:2050, SEQ ID NO:2051, SEQ ID NO:2052, SEQ ID NO:2053, SEQ ID NO:2054, SEQ ID NO:2055, SEQ ID NO:2056, SEQ ID NO:2057, SEQ ID NO:2058, SEQ ID NO:2059, SEQ ID NO:2060, SEQ ID NO:2061, SEQ ID NO:2062, SEQ ID NO:2063, SEQ ID NO:2064, SEQ ID NO:2065, SEQ ID NO:2066, SEQ ID NO:2067, SEQ ID NO:2068, SEQ ID NO:2069, SEQ ID NO:2070, SEQ ID NO:2071, SEQ ID NO:2072, SEQ ID NO:2073, SEQ ID NO:2074, SEQ ID NO:2075, SEQ ID NO:2076, SEQ ID NO:2077, SEQ ID NO:2078, SEQ ID NO:2079, SEQ ID NO:2080, SEQ ID NO:2081, SEQ ID NO:2082, SEQ ID NO:2083, SEQ ID NO:2084, SEQ ID NO:2085, SEQ ID NO:2086, SEQ ID NO:2087, SEQ ID NO:2088, SEQ ID NO:2089, SEQ ID NO:2090, SEQ ID NO:2091, SEQ ID NO:2092, SEQ ID NO:2093, SEQ ID NO:2094, SEQ ID NO:2095, SEQ ID NO:2096, SEQ ID NO:2097, SEQ ID NO:2098, SEQ ID NO:2099, SEQ ID NO:2100, SEQ ID NO:2101, SEQ ID NO:2102, SEQ ID NO:2103, SEQ ID NO:2104, SEQ ID NO:2105, SEQ ID NO:2106, SEQ ID NO:2107, SEQ ID NO:2108, SEQ ID NO:2109, SEQ ID NO:2110, SEQ ID NO:2111, SEQ ID NO:2112, SEQ ID NO:2113, SEQ ID NO:2114, SEQ ID NO:2115, SEQ ID NO:2116, SEQ ID NO:2117, SEQ ID NO:2118, SEQ ID NO:2119, SEQ ID NO:2120, SEQ ID NO:2121, SEQ ID NO:2122, SEQ ID NO:2123, SEQ ID NO:2124, SEQ ID NO:2125, SEQ ID NO:2126, SEQ ID NO:2127, SEQ ID NO:2128, SEQ ID NO:2129, SEQ ID NO:2130, SEQ ID NO:2131, SEQ ID NO:2132, SEQ ID NO:2133, SEQ ID NO:2134, SEQ ID NO:2135, SEQ ID NO:2136, SEQ ID NO:2137, SEQ ID NO:2138, SEQ ID NO:2139, SEQ ID NO:2140, SEQ ID NO:2141, SEQ ID NO:2142, SEQ ID NO:2143, SEQ ID NO:2144, SEQ ID NO:2145, SEQ ID NO:2146, SEQ ID NO:2147, SEQ ID NO:2148, SEQ ID NO:2149, SEQ ID NO:2150, SEQ ID NO:2151. Alternatively, the PCR uses corresponding probes consisting of nucleotide sequences selected from the group consisting of SEQ ID NO:1327, SEQ ID NO:1328, SEQ ID NO:1329, SEQ ID NO:1330, SEQ ID NO:1331, SEQ ID NO:1332, SEQ ID NO:1333, SEQ ID NO:1334, SEQ ID NO:1335, SEQ ID NO:1336, SEQ ID NO:1337, SEQ ID NO:1338, SEQ ID NO:1339, SEQ ID NO:1340, SEQ ID NO:1341, SEQ ID NO:1342, SEQ ID NO:1343, SEQ ID NO:1344, SEQ ID NO:1345, SEQ ID NO:1346, SEQ ID NO:1347, SEQ ID NO:1348, SEQ ID NO:1349, SEQ ID NO:1350, SEQ ID NO:1351, SEQ ID NO:1352, SEQ ID NO:1353, SEQ ID NO:1354, SEQ ID NO:1355, SEQ ID NO:1356, SEQ ID NO:1357, SEQ ID NO:1358, SEQ ID NO:1359, SEQ ID NO:1360, SEQ ID NO:1361, SEQ ID NO:1362, SEQ ID NO:1363, SEQ ID NO:1364, SEQ ID NO:1365, SEQ ID NO:1366, SEQ ID NO:1367, SEQ ID NO:1368, SEQ ID NO:1369, SEQ ID NO:1370, SEQ ID NO:1371, SEQ ID NO:1372, SEQ ID NO:1373, SEQ ID NO:1374, SEQ ID NO:1375, SEQ ID NO:1376, SEQ ID NO:1377, SEQ ID NO:1378, SEQ ID NO:1379, SEQ ID NO:1380, SEQ ID NO:1381, SEQ ID NO:1382, SEQ ID NO:1383, SEQ ID NO:1384, SEQ ID NO:1385, SEQ ID NO:1386, SEQ ID NO:1387, SEQ ID NO:1388, SEQ ID NO:1389, SEQ ID NO:1390, SEQ ID NO:1391, SEQ ID NO:1392, SEQ ID NO:1393, SEQ ID NO:1394, SEQ ID NO:1395, SEQ ID NO:1396, SEQ ID NO:1397, SEQ ID NO:1398, SEQ ID NO:1399, SEQ ID NO:1400, SEQ ID NO:1401, SEQ ID NO:1402, SEQ ID NO:1403, SEQ ID NO:1404, SEQ ID NO:1405, SEQ ID NO:1406, SEQ ID NO:1407, SEQ ID NO:1408, SEQ ID NO:1409, SEQ ID NO:1410, SEQ ID NO:1411, SEQ ID NO:1412, SEQ ID NO:1413, SEQ ID NO:1414, SEQ ID NO:1415, SEQ ID NO:1416, SEQ ID NO:1417, SEQ ID NO:1418, SEQ ID NO:1419, SEQ ID NO:1420, SEQ ID NO:1421, SEQ ID NO:1422, SEQ ID NO:1423, SEQ ID NO:1424, SEQ ID NO:1425, SEQ ID NO:1426, SEQ ID NO:1427, SEQ ID NO:1428, SEQ ID NO:1429, SEQ ID NO:1430, SEQ ID NO:1431, SEQ ID NO:1432, SEQ ID NO:1433, SEQ ID NO:1434, SEQ ID NO:1435, SEQ ID NO:1436, SEQ ID NO:1437, SEQ ID NO:1438, SEQ ID NO:1439, SEQ ID NO:1440, SEQ ID NO:1441, SEQ ID NO:1442, SEQ ID NO:1443, SEQ ID NO:1444, SEQ ID NO:1445, SEQ ID NO:1446, SEQ ID NO:1447, SEQ ID NO:1448, SEQ ID NO:1449, SEQ ID NO:1450, SEQ ID NO:1451, SEQ ID NO:1452, SEQ ID NO:1454, SEQ ID NO:1455, SEQ ID NO:1456, SEQ ID NO:1457, SEQ ID NO:1458, SEQ ID NO:1459, SEQ ID NO:1460, SEQ ID NO:1461, SEQ ID NO:1462, SEQ ID NO:1463, SEQ ID NO:1464, SEQ ID NO:1465, SEQ ID NO:1466, SEQ ID NO:1467, SEQ ID NO:1468, SEQ ID NO:1469, SEQ ID NO:1470, SEQ ID NO:1471, SEQ ID NO:1472, SEQ ID NO:1473, SEQ ID NO:1474, SEQ ID NO:1475, SEQ ID NO:1476, SEQ ID NO:1477, SEQ ID NO:1478, SEQ ID NO:1479, SEQ ID NO:1480, SEQ ID NO:1481, SEQ ID NO:1482, SEQ ID NO:1483, SEQ ID NO:1484, SEQ ID NO:1485, SEQ ID NO:1486, SEQ ID NO:1487, SEQ ID NO:1488, SEQ ID NO:1489, SEQ ID NO:1490, SEQ ID NO:1491, SEQ ID NO:1492, SEQ ID NO:1493, SEQ ID NO:1494, SEQ ID NO:1495, SEQ ID NO:1496, SEQ ID NO:1497, SEQ ID NO:1498, SEQ ID NO:1499, SEQ ID NO:1500, SEQ ID NO:1501, SEQ ID NO:1502, SEQ ID NO:1503, SEQ ID NO:1504, SEQ ID NO:1505, SEQ ID NO:1506, SEQ ID NO:1507, SEQ ID NO:1508, SEQ ID NO:1509, SEQ ID NO:1510, SEQ ID NO:1511, SEQ ID NO:1512, SEQ ID NO:1513, SEQ ID NO:1514, SEQ ID NO:1515, SEQ ID NO:1516, SEQ ID NO:1517, SEQ ID NO:1518, SEQ ID NO:1519, SEQ ID NO:1520, SEQ ID NO:1521, SEQ ID NO:1522, SEQ ID NO:1523, SEQ ID NO:1524, SEQ ID NO:1525, SEQ ID NO:1526, SEQ ID NO:1527, SEQ ID NO:1528, SEQ ID NO:1529, SEQ ID NO:1530, SEQ ID NO:1531, SEQ ID NO:1532, SEQ ID NO:1533, SEQ ID NO:1534, SEQ ID NO:1535, SEQ ID NO:1536, SEQ ID NO:1537, SEQ ID NO:1538, SEQ ID NO:1539, SEQ ID NO:1540, SEQ ID NO:1541, SEQ ID NO:1542, SEQ ID NO:1543, SEQ ID NO:1544, SEQ ID NO:1545, SEQ ID NO:1546, SEQ ID NO:1547, SEQ ID NO:1548, SEQ ID NO:1549, SEQ ID NO:1550, SEQ ID NO:1551, SEQ ID NO:1552, SEQ ID NO:1553, SEQ ID NO:1554, SEQ ID NO:1555, SEQ ID NO:1556, SEQ ID NO:1557, SEQ ID NO:1558, SEQ ID NO:1559, SEQ ID NO:1560, SEQ ID NO:1561, SEQ ID NO:1562, SEQ ID NO:1563, SEQ ID NO:1564, SEQ ID NO:1565, SEQ ID NO:1566, SEQ ID NO:1567, SEQ ID NO:1568, SEQ ID NO:1569, SEQ ID NO:1570, SEQ ID NO:1571, SEQ ID NO:1572, SEQ ID NO:1573, SEQ ID NO:1574, SEQ ID NO:1575, SEQ ID NO:1576, SEQ ID NO:1577, SEQ ID NO:1578, SEQ ID NO:1579, SEQ ID NO:1580, SEQ ID NO:1581, SEQ ID NO:1582, SEQ ID NO:1583, SEQ ID NO:1584, SEQ ID NO:1585, SEQ ID NO:1586, SEQ ID NO:1587, SEQ ID NO:1588, SEQ ID NO:1589, SEQ ID NO:1590, SEQ ID NO:1591, SEQ ID NO:1592, SEQ ID NO:1593, SEQ ID NO:1594, SEQ ID NO, SEQ ID NO:1595, SEQ ID NO:1596, SEQ ID NO:1597, SEQ ID NO:1598, SEQ ID NO:1599, SEQ ID NO:1600, SEQ ID NO:1601, SEQ ID NO:1602, SEQ ID NO:1603, SEQ ID
NO:1604, SEQ ID NO:1605, SEQ ID NO:1606, SEQ ID
NO:1607, SEQ ID NO:1608, SEQ ID NO:1609, SEQ ID
NO:1610, SEQ ID NO:1611, SEQ ID NO:1612, SEQ ID
NO:1613, SEQ ID NO:1614, SEQ ID NO:1615, SEQ ID
NO:1616, SEQ ID NO:1617, SEQ ID NO:1618, SEQ ID
NO:1619, SEQ ID NO:1620, SEQ ID NO:1621, SEQ ID
NO:1622, SEQ ID NO:1623, SEQ ID NO:1624, SEQ ID
NO:1625, SEQ ID NO:1626, SEQ ID NO:1627, SEQ ID
NO:1628, SEQ ID NO:1629, SEQ ID NO:1630, SEQ ID
NO:1631, SEQ ID NO:1632, SEQ ID NO:1633, SEQ ID
NO:1634, SEQ ID NO:1635, SEQ ID NO:1636, SEQ ID
NO:1637, SEQ ID NO:1638, SEQ ID NO:1639, SEQ ID
NO:1640, SEQ ID NO:1641, SEQ ID NO:1642, SEQ ID
NO:1643, SEQ ID NO:1644, SEQ ID NO:1645, SEQ ID
NO:1646, SEQ ID NO:1647, SEQ ID NO:1648, SEQ ID
NO:1649, SEQ ID NO:1650, SEQ ID NO:1651, SEQ ID
NO:1652, SEQ ID NO:1653, SEQ ID NO:1654, SEQ ID
NO:1655, SEQ ID NO:1656, SEQ ID NO:1657, SEQ ID
NO:2152, SEQ ID NO, SEQ ID NO:2153, SEQ ID NO, SEQ
ID NO:2154, SEQ ID NO, SEQ ID NO, SEQ ID NO, SEQ ID
NO:2145, SEQ ID NO, SEQ ID NO:2156, SEQ ID NO:2157,
SEQ ID NO:2158, SEQ ID NO:2159, SEQ ID NO, SEQ ID
NO:2160, SEQ ID NO:2161, SEQ ID NO:2162, SEQ ID
NO:2163, SEQ ID NO:2164, SEQ ID NO, SEQ ID NO:2165,
SEQ ID NO, SEQ ID NO:2166, SEQ ID NO:2167, SEQ ID
NO:2168, SEQ ID NO:2169, SEQ ID NO:2170, SEQ ID
NO:2171, SEQ ID NO:2172, SEQ ID NO:2173, SEQ ID
NO:2174, SEQ ID NO:2175, SEQ ID NO:2176, SEQ ID
NO:2177, SEQ ID NO:2178, SEQ ID NO:2179, SEQ ID
NO:2180, SEQ ID NO:2181, SEQ ID NO:2182, SEQ ID
NO:2183, SEQ ID NO:2184, SEQ ID NO:2185, SEQ ID
NO:2186, SEQ ID NO:2187, SEQ ID NO:2188, SEQ ID
NO:2189, SEQ ID NO:2190, SEQ ID NO:2191, SEQ ID
NO:2192, SEQ ID NO:2193, SEQ ID NO:2194, SEQ ID
NO:2195, SEQ ID NO:2196, SEQ ID NO:2197, SEQ ID
NO:2198, SEQ ID NO:2199, SEQ ID NO:2200, SEQ ID
NO:2219, SEQ ID NO:2202, SEQ ID NO:2203, SEQ ID
NO:2204, SEQ ID NO:2205, SEQ ID NO:2206, SEQ ID
NO:2207, SEQ ID NO:2208, SEQ ID NO:2209, SEQ ID
NO:2210, SEQ ID NO:2211, SEQ ID NO:2212, SEQ ID
NO:2213, SEQ ID NO:2214, SEQ ID NO:2215, SEQ ID
NO:2216, SEQ ID NO:2217, SEQ ID NO:2218, SEQ ID
NO:2219, SEQ ID NO:2220, SEQ ID NO:2221, SEQ ID
NO:2222, SEQ ID NO:2223, SEQ ID NO:2224, SEQ ID
NO:2225, SEQ ID NO:2226, SEQ ID NO:2227, SEQ ID
NO:2228, SEQ ID NO:2229, SEQ ID NO:2230, SEQ ID
NO:2231, SEQ ID NO:2232, SEQ ID NO:2233, SEQ ID
NO:2234, SEQ ID NO:2235, SEQ ID NO:2236, SEQ ID
NO:2237, SEQ ID NO:2238, SEQ ID NO:2239, SEQ ID
NO:2240, SEQ ID NO:2241, SEQ ID NO:2242, SEQ ID
NO:2243, SEQ ID NO:2244, SEQ ID NO:2245, SEQ ID
NO:2246, SEQ ID NO:2247, SEQ ID NO:2248, SEQ ID
NO:2249, SEQ ID NO:2250, SEQ ID NO:2251, SEQ ID
NO:2252, SEQ ID NO:2253, SEQ ID NO:2254, SEQ ID
NO:2255, SEQ ID NO:2256, SEQ ID NO:2257, SEQ ID
NO:2258, SEQ ID NO:2259, SEQ ID NO:2260, SEQ ID
NO:2261, SEQ ID NO:2262, SEQ ID NO:2263, SEQ ID
NO:2264, SEQ ID NO:2265, SEQ ID NO:2266, SEQ ID
NO:2267, SEQ ID NO:2268, SEQ ID NO:2269, SEQ ID
NO:2270, SEQ ID NO:2271, SEQ ID NO:2272, SEQ ID
NO:2273, SEQ ID NO:2274, SEQ ID NO:2275, SEQ ID
NO:2276, SEQ ID NO:2277, SEQ ID NO:2278, SEQ ID
NO:2279, SEQ ID NO:2280, SEQ ID NO:2281, SEQ ID
NO:2282, SEQ ID NO:2283, SEQ ID NO:2284, SEQ ID
NO:2285, SEQ ID NO:2286, SEQ ID NO:2287, SEQ ID
NO:2288, SEQ ID NO:2289, SEQ ID NO:2290, SEQ ID
NO:2291, SEQ ID NO:2292, SEQ ID NO:2293, SEQ ID
NO:2294, SEQ ID NO:2295, SEQ ID NO:2296, SEQ ID
NO:2297, SEQ ID NO:2298, SEQ ID NO:2299, SEQ ID
NO:2300, SEQ ID NO:2301, SEQ ID NO:2302, SEQ ID
NO:2303, SEQ ID NO:2304, SEQ ID NO:2305, SEQ ID
NO:2306, SEQ ID NO:2307, SEQ ID NO:2308, SEQ ID
NO:2309, SEQ ID NO:2310, SEQ ID NO:2310, SEQ ID
NO:2312, SEQ ID NO:2303, SEQ ID NO:2314, SEQ ID
NO:2315, SEQ ID NO:2316, SEQ ID NO:2317, SEQ ID
NO:2318, SEQ ID NO:2319, SEQ ID NO:2320, SEQ ID
NO:2321, SEQ ID NO:2322, SEQ ID NO:2323, SEQ ID
NO:2324, SEQ ID NO:2325, SEQ ID NO:2326, SEQ ID
NO:2327, SEQ ID NO:2328, SEQ ID NO:2329, SEQ ID
NO:2330, SEQ ID NO:2331, SEQ ID NO:2332, SEQ ID
NO:2333, SEQ ID NO:2334, SEQ ID NO:2335, SEQ ID
NO:2336, SEQ ID NO:2337, SEQ ID NO:2338, SEQ ID
NO:2339, SEQ ID NO:2340, SEQ ID NO:2341, SEQ ID
NO:2342, SEQ ID NO:2343, SEQ ID NO:2344, SEQ ID
NO:2345, SEQ ID NO:2346, SEQ ID NO:2347, SEQ ID
NO:2348, SEQ ID NO:2349, SEQ ID NO:2350, SEQ ID
NO:2351, SEQ ID NO:2352, SEQ ID NO:2353, SEQ ID
NO:2354, SEQ ID NO:2355, SEQ ID NO:2356, SEQ ID
NO:2357, SEQ ID NO:2358, SEQ ID NO:2359, SEQ ID
NO:2360, SEQ ID NO:2361, SEQ ID NO:2362, SEQ ID
NO:2363, SEQ ID NO:2364, SEQ ID NO:2365, SEQ ID
NO:2366, SEQ ID NO:2367, SEQ ID NO:2368, SEQ ID
NO:2369, SEQ ID NO:2370, SEQ ID NO:2371, SEQ ID
NO:2372, SEQ ID NO:2373, SEQ ID NO:2374, SEQ ID
NO:2375, SEQ ID NO:2376, SEQ ID NO:2377, SEQ ID
NO:2378, SEQ ID NO:2379, SEQ ID NO:2380, SEQ ID
NO:2381, SEQ ID NO:2382, SEQ ID NO:2383, SEQ ID
NO:2384, SEQ ID NO:2385, SEQ ID NO:2386, SEQ ID
NO:2387, SEQ ID NO:2388, SEQ ID NO:2389, SEQ ID
NO:2390, SEQ ID NO:2391, SEQ ID NO:2392, SEQ ID
NO:2393, SEQ ID NO:2394, SEQ ID NO:2395, SEQ ID
NO:2396, SEQ ID NO:2397, SEQ ID NO:2398, SEQ ID
NO:2399. The RNA level may be detected by hybridization to the probes. In a further variation, the RNA level is detected by hybridization to an oligonucleotide. Examples of oligonucleotide include oligonucleotides having a nucleotide sequence selected from SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, SEQ ID NO:97, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:140, SEQ ID NO:141, SEQ ID NO:142, SEQ ID NO:143, SEQ ID NO:144, SEQ ID NO:145, SEQ ID NO:146, SEQ ID NO:147, SEQ ID NO:148, SEQ ID NO:149, SEQ ID NO:150, SEQ ID NO:151, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:173, SEQ ID NO:174, SEQ ID NO:175, SEQ ID NO:176, SEQ ID NO:177, SEQ ID NO:178, SEQ ID NO:179, SEQ ID NO:180, SEQ ID NO:181, SEQ ID NO:182, SEQ ID NO:183, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, SEQ ID NO:217, SEQ ID NO:218, SEQ ID NO:219, SEQ ID NO:220, SEQ ID NO:221, SEQ ID NO:222, SEQ ID NO:223, SEQ ID NO:224, SEQ ID NO:225, SEQ ID NO:226, SEQ ID NO:227, SEQ ID NO:228, SEQ ID NO:229, SEQ ID NO:230, SEQ ID NO:231, SEQ ID NO:232, SEQ ID NO:233, SEQ ID NO:234, SEQ ID NO:235, SEQ ID NO:236, SEQ ID NO:237, SEQ ID NO:238, SEQ ID NO:239, SEQ ID NO:240, SEQ ID NO:241, SEQ ID NO:242, SEQ ID NO:243, SEQ ID NO:244, SEQ ID NO:245, SEQ ID NO:246, SEQ ID NO:247, SEQ ID NO:248, SEQ ID NO:249, SEQ ID NO:250, SEQ ID NO:251, SEQ ID NO:252, SEQ ID NO:253, SEQ ID NO:254, SEQ ID NO:255, SEQ ID NO:256, SEQ ID NO:257, SEQ ID NO:258, SEQ ID NO:259, SEQ ID NO:260, SEQ ID NO:261, SEQ ID NO:262, SEQ ID NO:263, SEQ ID NO:264, SEQ ID NO:265, SEQ ID NO:266, SEQ ID NO:267, SEQ ID NO:268, SEQ ID NO:269, SEQ ID NO:270, SEQ ID NO:271, SEQ ID NO:272, SEQ ID NO:273, SEQ ID NO:274, SEQ ID NO:275, SEQ ID NO:276, SEQ ID NO:277, SEQ ID NO:278, SEQ ID NO:279, SEQ ID NO:280, SEQ ID NO:281, SEQ ID NO:282, SEQ ID NO:283, SEQ ID NO:284, SEQ ID NO:285, SEQ ID NO:286, SEQ ID NO:287, SEQ ID NO:288, SEQ ID NO:289, SEQ ID NO:290, SEQ ID NO:291, SEQ ID NO:292, SEQ ID NO:293, SEQ ID NO:294, SEQ ID NO:295, SEQ ID NO:296, SEQ ID NO:297, SEQ ID NO:298, SEQ ID NO:299, SEQ ID NO:300, SEQ ID NO:301, SEQ ID NO:302, SEQ ID NO:303, SEQ ID NO:304, SEQ ID NO:305, SEQ ID NO:306, SEQ ID NO:307, SEQ ID NO:308, SEQ ID NO:309, SEQ ID NO:310, SEQ ID NO:311, SEQ ID NO:312, SEQ ID NO:313, SEQ ID NO:314, SEQ ID NO:315, SEQ ID NO:316, SEQ ID NO:317, SEQ ID NO:318, SEQ ID NO:319, SEQ ID NO:320, SEQ ID NO:321, SEQ ID NO:322, SEQ ID NO:323, SEQ ID NO:324, SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:2697, SEQ ID NO:2645, SEQ ID NO:2707, SEQ ID NO:2679, SEQ ID NO:2717, SEQ ID NO:2646, SEQ ID NO:2667, SEQ ID NO:2706, SEQ ID NO:2740, SEQ ID NO:2669, SEQ ID NO:2674, SEQ ID NO:2743, SEQ ID NO:2716, SEQ ID NO:2727, SEQ ID NO:2721, SEQ ID NO:2641, SEQ ID NO:2671, SEQ ID NO:2752, SEQ ID NO:2737, SEQ ID NO:2719, SEQ ID NO:2684, SEQ ID NO:2677, SEQ ID NO:2748, SEQ ID NO:2703, SEQ ID NO:2711, SEQ ID NO:2663, SEQ ID NO:2657, SEQ ID NO:2683, SEQ ID NO:2686, SEQ ID NO:2687, SEQ ID NO:2644, SEQ ID NO:2664, SEQ ID NO:2747, SEQ ID NO:2744, SEQ ID NO:2678, SEQ ID NO:2731, SEQ ID NO:2713, SEQ ID NO:2736, SEQ ID NO:2708, SEQ ID NO:2670, SEQ ID NO:2661, SEQ ID NO:2680, SEQ ID NO:2754, SEQ ID NO:2728, SEQ ID NO:2742, SEQ ID NO:2668, SEQ ID NO:2750, SEQ ID NO:2746, SEQ ID NO:2738, SEQ ID NO:2627, SEQ ID NO:2739, SEQ ID NO:2647, SEQ ID NO:2628, SEQ ID NO:2638, SEQ ID NO:2725, SEQ ID NO:2714, SEQ ID NO:2635, SEQ ID NO:2751, SEQ ID NO:2629, SEQ ID NO:2695, SEQ ID NO:2741, SEQ ID NO:2691, SEQ ID NO:2726, SEQ ID NO:2722, SEQ ID NO:2689, SEQ ID NO:2734, SEQ ID NO:2631, SEQ ID NO:2656, SEQ ID NO:2696, SEQ ID NO:2676, SEQ ID NO:2701, SEQ ID NO:2730, SEQ ID NO:2710, SEQ ID NO:2632, SEQ ID NO:2724, SEQ ID NO:2698, SEQ ID NO:2662, SEQ ID NO:2753, SEQ ID NO:2704, SEQ ID NO:2675, SEQ ID NO:2700, SEQ ID NO:2640, SEQ ID NO:2723, SEQ ID NO:2658, SEQ ID NO:2688, SEQ ID NO:2735, SEQ ID NO:2702, SEQ ID NO:2681, SEQ ID NO:2755, SEQ ID NO:2715, SEQ ID NO:2732, SEQ ID NO:2652, SEQ ID NO:2651, SEQ ID NO:2718, SEQ ID NO:2673, SEQ ID NO:2733, SEQ ID NO:2712, SEQ ID NO:2659, SEQ ID NO:2654, SEQ ID NO:2636, SEQ ID NO:2639, SEQ ID NO:2690, SEQ ID NO:2705, SEQ ID NO:2685, SEQ ID NO:2692, SEQ ID NO:2693, SEQ ID NO:2648, SEQ ID NO:2650, SEQ ID NO:2720, SEQ ID NO:2660, SEQ ID NO:2666, SEQ ID NO:2699, SEQ ID NO:2633, SEQ ID NO:2672, SEQ ID NO:2642, SEQ ID NO:2682, SEQ ID NO:2655, SEQ ID NO:2630, SEQ ID NO:2745, SEQ ID NO:2643, SEQ ID NO:2694, SEQ ID NO:2749, SEQ ID NO:2665, SEQ ID NO:2649, SEQ ID NO:2637, SEQ ID NO:2634, SEQ ID NO:2709, SEQ ID NO:2653, SEQ ID NO:2729. In a further variation, the oligonucleotide has the nucleotide sequence SEQ ID NO:36. In still a further variation, the oligonucleotide has the nucleotide sequence SEQ ID NO:87. In yet a further variation, the oligonucleotide has the nucleotide sequence SEQ ID NO:94. In an additional variation, the oligonucleotide has a nucleotide sequence consisting of SEQ ID NO:91. In another variation, the oligonucleotide has a nucleotide sequence consisting of SEQ ID NO: 107. The oligonucleotide may be DNA, RNA, cDNA, PNA, genomic DNA, or synthetic oligonucleotides.

In another aspect, the methods of detecting transplant rejection include detecting the expression level by measuring one or more proteins expressed by the one or more genes. In one variation, the one or more proteins include an amino acid sequence selected from SEQ ID NO:2400, SEQ ID NO:2401, SEQ ID NO:2402, SEQ ID NO:2403, SEQ ID NO:2404, SEQ ID NO:2405, SEQ ID NO:2407, SEQ ID NO:2408, SEQ ID NO:2409, SEQ ID NO:2410, SEQ ID NO:2411, SEQ ID NO:2412, SEQ ID NO:2413, SEQ ID NO:2414, SEQ ID NO:2415, SEQ ID NO:2416, SEQ ID NO:2417, SEQ ID NO:2418, SEQ ID NO:2419, SEQ ID NO:2420, SEQ ID NO:2421, SEQ ID NO:2422, SEQ ID NO:2423, SEQ ID NO:2424, SEQ ID NO:2425, SEQ ID NO:2426, SEQ ID NO:2427, SEQ ID NO:2428, SEQ ID NO:2429, SEQ ID NO:2430, SEQ ID NO:2432, SEQ ID NO:2433, SEQ ID NO:2434, SEQ ID NO:2435, SEQ ID NO:2436, SEQ ID NO:2437, SEQ ID NO:2438, SEQ ID NO:2439, SEQ ID NO:2440, SEQ ID NO:2441, SEQ ID NO:2442, SEQ ID NO:2443, SEQ ID NO:2444, SEQ ID NO:2445, SEQ ID NO:2446, SEQ ID NO:2447, SEQ ID NO:2448, SEQ ID NO:2449, SEQ ID NO:2450, SEQ ID NO:2451, SEQ ID NO:2452, SEQ ID NO:2453, SEQ ID NO:2454, SEQ ID NO:2455, SEQ ID NO:2456, SEQ ID NO:2457, SEQ ID NO:2458, SEQ ID NO:2459, SEQ ID NO:2460, SEQ ID NO:2461, SEQ ID NO:2462, SEQ ID NO:2463, SEQ ID NO:2464, SEQ ID NO:2465, SEQ ID NO:2466, SEQ ID NO:2467, SEQ ID NO:2468, SEQ ID NO:2469, SEQ ID NO:2470, SEQ ID NO:2478, SEQ ID NO:2479, SEQ ID NO:2480, SEQ ID NO:2481, SEQ ID NO:2482, SEQ ID NO:2483, SEQ ID NO:2485, SEQ ID NO:2486, SEQ ID NO:2488, SEQ ID NO:2491, SEQ ID NO:2492, SEQ ID NO:2493, SEQ ID NO:2494, SEQ ID NO:2495, SEQ ID NO:2496, SEQ ID NO:2497, SEQ ID NO:2502, SEQ ID NO:2503, SEQ ID NO:2504, SEQ ID NO:2505, SEQ ID NO:2506, SEQ ID NO:2507, SEQ ID NO:2508, SEQ ID NO:2509, SEQ ID NO:2510, SEQ ID NO:2511, SEQ ID NO:2512, SEQ ID NO:2513, SEQ ID NO:2514, SEQ ID NO:2515, SEQ ID NO:2516, SEQ ID NO:2517, SEQ ID NO:2518, SEQ ID NO:2519, SEQ ID NO:2520, SEQ ID NO:2521, SEQ ID NO:2528, SEQ ID NO:2529, SEQ ID NO:2530, SEQ ID NO:2531, SEQ ID NO:2532, SEQ ID NO:2533, SEQ ID NO:2534, SEQ ID NO:2535, SEQ ID NO:2536, SEQ ID NO:2537, SEQ ID NO:2538, SEQ ID NO:2539, SEQ ID NO:2540, SEQ ID NO:2541, SEQ ID NO:2542, SEQ ID NO:2543, SEQ ID NO:2544, SEQ ID NO:2545, SEQ ID NO:2546, SEQ ID NO:2547, SEQ ID NO:2548, SEQ ID NO:2549, SEQ ID NO:2550, SEQ ID NO:2551, SEQ ID NO:2552, SEQ ID NO:2553, SEQ ID NO:2554, SEQ ID NO:2555, SEQ ID NO:2556, SEQ ID NO:2557, SEQ ID NO:2558, SEQ ID NO:2559, SEQ ID NO:2560, SEQ ID NO:2561, SEQ ID NO:2562, SEQ ID NO:2563, SEQ ID NO:2564, SEQ ID NO:2565, SEQ ID NO:2566, SEQ ID NO:2567, SEQ ID NO:2568, SEQ ID NO:2569, SEQ ID NO:2570, SEQ ID NO:2571, SEQ ID NO:2572, SEQ ID NO:2573, SEQ ID NO:2574, SEQ ID NO:2575, SEQ ID NO:2576, SEQ ID NO:2577, SEQ ID NO:2578, SEQ ID NO:2579, SEQ ID NO:2580, SEQ ID NO:2581, SEQ ID NO:2582, SEQ ID NO:2583, SEQ ID NO:2584, SEQ ID NO:2585, SEQ ID NO:2586, SEQ ID NO:2587, SEQ ID NO:2588, SEQ ID NO:2589, SEQ ID NO:2590, SEQ ID NO:2591, SEQ ID NO:2592, SEQ ID NO:2593, SEQ ID NO:2594, SEQ ID NO:2595, SEQ ID NO:2596, SEQ ID NO:2597, SEQ ID NO:2598, SEQ ID NO:2599, SEQ ID NO:2600, SEQ ID NO:2601, SEQ ID NO:2602, SEQ ID NO:2603, SEQ ID NO:2604, SEQ ID NO:2605, SEQ ID NO:2606, SEQ ID NO:2607, SEQ ID NO:2608, SEQ ID NO:2609, SEQ ID NO:2610, SEQ ID NO:2611, SEQ ID NO:2612, SEQ ID NO:2613, SEQ ID NO:2614, SEQ ID NO:2615, SEQ ID NO:2616, SEQ ID NO:2617, SEQ ID NO:2618, SEQ ID NO:2619, SEQ ID NO:2620, SEQ ID NO:2621, SEQ ID NO:2622, SEQ ID NO:2623, SEQ ID NO:2624, SEQ ID NO:2625, SEQ ID NO:2626, SEQ ID NO:2925, SEQ ID NO:2926, SEQ ID NO:2927, SEQ ID NO:2928, SEQ ID NO:2929, SEQ ID NO:2930, SEQ ID NO:2932, SEQ ID NO:2933, SEQ ID NO:2935, SEQ ID NO:2936, SEQ ID NO:2937, SEQ ID NO:2938, SEQ ID NO:2939, SEQ ID NO:2941, SEQ ID NO:2942, SEQ ID NO:2943, SEQ ID NO:2945, SEQ ID NO:2946, SEQ ID NO:2947, SEQ ID NO:2948, SEQ ID NO:2949, SEQ ID NO:2950, SEQ ID NO:2951, SEQ ID NO:2952, SEQ ID NO:2953, SEQ ID NO:2954, SEQ ID NO:2955, SEQ ID NO:2956, SEQ ID NO:2957, SEQ ID NO:2959, SEQ ID NO:2960, SEQ ID NO:2961, SEQ ID NO:2962, SEQ ID NO:2963, SEQ ID NO:2964, SEQ ID NO:2965, SEQ ID NO:2966, SEQ ID NO:2967, SEQ ID NO:2968, SEQ ID NO:2969, SEQ ID NO:2970, SEQ ID NO:2971, SEQ ID NO:2972, SEQ ID NO:2973, SEQ ID NO:2974, SEQ ID NO:2975, SEQ ID NO:2976, SEQ ID NO:2977, SEQ ID NO:2978, SEQ ID NO:2979, SEQ ID NO:2980, SEQ ID NO:2981, SEQ ID NO:2982, SEQ ID NO:2983, SEQ ID NO:2984, SEQ ID NO:2985, SEQ ID NO:2986, SEQ ID NO:2987, SEQ ID NO:2988, SEQ ID NO:2989, SEQ ID NO:2990, SEQ ID NO:2991, SEQ ID NO:2992, SEQ ID NO:2993, SEQ ID NO:2994, SEQ ID NO:2995, SEQ ID NO:2996, SEQ ID NO:2997, SEQ ID NO:2998, SEQ ID NO:2999, SEQ ID NO:3000, SEQ ID NO:3001, SEQ ID NO:3002, SEQ ID NO:3003, SEQ ID NO:3004, SEQ ID NO:3005, SEQ ID NO:3006, SEQ ID NO:3007, SEQ ID NO:3008, SEQ ID NO:3009, SEQ ID NO:3010, SEQ ID NO:3011, SEQ ID NO:3012, SEQ ID NO:3013, SEQ ID NO:3014, SEQ ID NO:3015. In a further variation, the method includes detecting one or more additional proteins expressed by SEQ ID NO:2406, SEQ ID NO:2431, SEQ ID NO:2471, SEQ ID NO:2472, SEQ ID NO:2473, SEQ ID NO:2474, SEQ ID NO:2475, SEQ ID NO:2476, SEQ ID NO:2477, SEQ ID NO:2484, SEQ ID NO:2487, SEQ ID NO:2489, SEQ ID NO:2490, SEQ ID NO:2498, SEQ ID NO:2499, SEQ ID NO:2500, SEQ ID NO:2501, SEQ ID NO:2522, SEQ ID NO:2523, SEQ ID NO:2524, SEQ ID NO:2525, SEQ ID NO:2526, SEQ ID NO:2527. In still another variation, one or more proteins may be selected from SEQ ID NO:2400, SEQ ID NO:2401, SEQ ID NO:2402, SEQ ID NO:2403, SEQ ID NO:2404, SEQ ID NO:2405, SEQ ID NO:2407, SEQ ID NO:2408, SEQ ID NO:2409, SEQ ID NO:2410, SEQ ID NO:2411, SEQ ID NO:2412, SEQ ID NO:2413, SEQ ID NO:2414, SEQ ID NO:2415, SEQ ID NO:2416, SEQ ID NO:2417, SEQ ID NO:2418, SEQ ID NO:2419, SEQ ID NO:2420, SEQ ID NO:2421, SEQ ID NO:2422, SEQ ID NO:2423, SEQ ID NO:2424, SEQ ID NO:2425, SEQ ID NO:2426, SEQ ID NO:2427, SEQ ID NO:2428, SEQ ID NO:2429, SEQ ID NO:2430, SEQ ID NO:2432, SEQ ID NO:2433, SEQ ID NO:2434, SEQ ID NO:2435, SEQ ID NO:2436, SEQ ID NO:2437, SEQ ID NO:2438, SEQ ID NO:2439, SEQ ID NO:2440, SEQ ID NO:2441, SEQ ID NO:2442, SEQ ID NO:2443, SEQ ID NO:2444, SEQ ID NO:2445, SEQ ID NO:2446, SEQ ID NO:2447, SEQ ID NO:2448, SEQ ID NO:2449, SEQ ID NO:2450, SEQ ID NO:2451, SEQ ID NO:2452, SEQ ID NO:2453, SEQ ID NO:2454, SEQ ID NO:2455, SEQ ID NO:2456, SEQ ID NO:2457, SEQ ID NO:2458, SEQ ID NO:2459, SEQ ID NO:2460, SEQ ID NO:2461, SEQ ID NO:2462, SEQ ID NO:2463, SEQ ID NO:2464, SEQ ID NO:2465, SEQ ID NO:2466, SEQ ID NO:2467, SEQ ID NO:2468, SEQ ID NO:2469, SEQ ID NO:2470, SEQ ID NO:2478, SEQ ID NO:2479, SEQ ID NO:2480, SEQ ID NO:2481, SEQ ID NO:2482, SEQ ID NO:2483, SEQ ID NO:2485, SEQ ID NO:2486, SEQ ID NO:2488, SEQ ID NO:2491, SEQ ID NO:2492, SEQ ID NO:2493, SEQ ID NO:2494, SEQ ID NO:2495, SEQ ID NO:2496, SEQ ID NO:2497, SEQ ID NO:2502, SEQ ID NO:2503, SEQ ID NO:2504, SEQ ID NO:2505, SEQ ID NO:2506, SEQ ID NO:2507, SEQ ID NO:2508, SEQ ID NO:2509, SEQ ID NO:2510, SEQ ID NO:2511, SEQ ID NO:2512, SEQ ID NO:2513, SEQ ID NO:2514, SEQ ID NO:2515, SEQ ID NO:2516, SEQ ID NO:2517, SEQ ID NO:2518, SEQ ID NO:2519, SEQ ID NO:2520, SEQ ID NO:2521, SEQ ID NO:2528, SEQ ID NO:2529, SEQ ID NO:2530, SEQ ID NO:2531, SEQ ID NO:2532, SEQ ID NO:2533, SEQ ID NO:2534, SEQ ID NO:2535, SEQ ID NO:2536, SEQ ID NO:2537, SEQ ID NO:2538, SEQ ID NO:2539, SEQ ID NO:2540, SEQ ID NO:2541, SEQ ID NO:2542, SEQ ID NO:2543, SEQ ID NO:2544, SEQ ID NO:2545, SEQ ID NO:2546, SEQ ID NO:2547, SEQ ID NO:2548, SEQ ID NO:2549, SEQ ID NO:2550, SEQ ID NO:2551, SEQ ID NO:2552, SEQ ID NO:2553, SEQ ID NO:2554, SEQ ID NO:2555, SEQ ID NO:2556, SEQ ID NO:2557, SEQ ID NO:2558, SEQ ID NO:2559, SEQ ID NO:2560, SEQ ID NO:2561, SEQ ID NO:2562, SEQ ID NO:2563, SEQ ID NO:2564, SEQ ID NO:2565, SEQ ID NO:2566, SEQ ID NO:2567, SEQ ID NO:2568, SEQ ID NO:2569, SEQ ID NO:2570, SEQ ID NO:2571, SEQ ID NO:2572, SEQ ID NO:2573, SEQ ID NO:2574, SEQ ID NO:2575, SEQ ID NO:2576, SEQ ID NO:2577, SEQ ID NO:2578, SEQ ID NO:2579, SEQ ID NO:2580, SEQ ID NO:2581, SEQ ID NO:2582, SEQ ID NO:2583, SEQ ID NO:2584, SEQ ID NO:2585, SEQ ID NO:2586, SEQ ID NO:2587, SEQ ID NO:2588, SEQ ID NO:2589, SEQ ID NO:2590, SEQ ID NO:2591, SEQ ID NO:2592, SEQ ID NO:2593, SEQ ID NO:2594, SEQ ID NO:2595, SEQ ID NO:2596, SEQ ID NO:2597, SEQ ID NO:2598, SEQ ID NO:2599, SEQ ID NO:2600, SEQ ID NO:2601, SEQ ID NO:2602, SEQ ID NO:2603, SEQ ID NO:2604, SEQ ID NO:2605, SEQ ID NO:2606, SEQ ID NO:2607, SEQ ID NO:2608, SEQ ID NO:2609, SEQ ID NO:2610, SEQ ID NO:2611, SEQ ID NO:2612, SEQ ID NO:2613, SEQ ID NO:2614, SEQ ID NO:2615, SEQ ID NO:2616, SEQ ID NO:2617, SEQ ID NO:2618, SEQ ID NO:2619, SEQ ID NO:2620, SEQ ID NO:2621, SEQ ID NO:2622, SEQ ID NO:2623, SEQ ID NO:2624, SEQ ID NO:2625, SEQ ID NO:2626, SEQ ID NO:2925, SEQ ID NO:2926, SEQ ID NO:2927, SEQ ID NO:2928, SEQ ID NO:2929, SEQ ID NO:2930, SEQ ID NO:2932, SEQ ID NO:2933, SEQ ID NO:2935, SEQ ID NO:2936, SEQ ID NO:2937, SEQ ID NO:2938, SEQ ID NO:2939, SEQ ID NO:2941, SEQ ID NO:2942, SEQ ID NO:2943, SEQ ID NO:2945, SEQ ID NO:2946, SEQ ID NO:2947, SEQ ID NO:2948, SEQ ID NO:2949, SEQ ID NO:2950, SEQ ID NO:2951, SEQ ID NO:2952, SEQ ID NO:2953, SEQ ID NO:2954, SEQ ID NO:2955, SEQ ID NO:2956, SEQ ID NO:2957, SEQ ID NO:2959, SEQ ID NO:2960, SEQ ID NO:2961, SEQ ID NO:2962, SEQ ID NO:2963, SEQ ID NO:2964, SEQ ID NO:2965, SEQ ID NO:2966, SEQ ID NO:2967, SEQ ID NO:2968, SEQ ID NO:2969, SEQ ID NO:2970, SEQ ID NO:2971, SEQ ID NO:2972, SEQ ID NO:2973, SEQ ID NO:2974, SEQ ID NO:2975, SEQ ID NO:2976, SEQ ID NO:2977, SEQ ID NO:2978, SEQ ID NO:2979, SEQ ID NO:2980, SEQ ID NO:2981, SEQ ID NO:2982, SEQ ID NO:2983, SEQ ID NO:2984, SEQ ID NO:2985, SEQ ID NO:2986, SEQ ID NO:2987, SEQ ID NO:2988, SEQ ID NO:2989, SEQ ID NO:2990, SEQ ID NO:2991, SEQ ID NO:2992, SEQ ID NO:2993, SEQ ID NO:2994, SEQ ID NO:2995, SEQ ID NO:2996, SEQ ID NO:2997, SEQ ID NO:2998, SEQ ID NO:2999, SEQ ID NO:3000, SEQ ID NO:3001, SEQ ID NO:3002, SEQ ID NO:3003, SEQ ID NO:3004, SEQ ID NO:3005, SEQ ID NO:3006, SEQ ID NO:3007, SEQ ID NO:3008, SEQ ID NO:3009, SEQ ID NO:3010, SEQ ID NO:3011, SEQ ID NO:3012, SEQ ID NO:3013, SEQ ID NO:3014, SEQ ID NO:3015, and one or more proteins may be selected from SEQ ID NO:2406, SEQ ID NO:2431, SEQ ID NO:2471, SEQ ID NO:2472, SEQ ID NO:2473, SEQ ID NO:2474, SEQ ID NO:2475, SEQ ID NO:2476, SEQ ID NO:2477, SEQ ID NO:2484, SEQ ID NO:2487, SEQ ID NO:2489, SEQ ID NO:2490, SEQ ID NO:2498, SEQ ID NO:2499, SEQ ID NO:2500, SEQ ID NO:2501, SEQ ID NO:2522, SEQ ID NO:2523, SEQ ID NO:2524, SEQ ID NO:2525, SEQ ID NO:2526, SEQ ID NO:2527.

In another aspect, the method of diagnosing or monitoring cardiac transplant rejection in a patient includes detecting the expression level of one or more genes in the patient to diagnose or monitor cardiac transplant rejection in the patient by measuring one or more proteins expressed by the one or more genes. The one or more proteins may include an amino acid sequence selected from SEQ ID NO:2400, SEQ ID NO:2401, SEQ ID NO:2402, SEQ ID NO:2403, SEQ ID NO:2404, SEQ ID NO:2405, SEQ ID NO:2407, SEQ ID NO:2408, SEQ ID NO:2409, SEQ ID NO:2410, SEQ ID NO:2411, SEQ ID NO:2412, SEQ ID NO:2413, SEQ ID NO:2414, SEQ ID NO:2415, SEQ ID NO:2416, SEQ ID NO:2417, SEQ ID NO:2418, SEQ ID NO:2419, SEQ ID NO:2420, SEQ ID NO:2421, SEQ ID NO:2422, SEQ ID NO:2423, SEQ ID NO:2424, SEQ ID NO:2425, SEQ ID NO:2426, SEQ ID NO:2427, SEQ ID NO:2428, SEQ ID NO:2429, SEQ ID NO:2430, SEQ ID NO:2432, SEQ ID NO:2433, SEQ ID NO:2434, SEQ ID NO:2435, SEQ ID NO:2436, SEQ ID NO:2437, SEQ ID NO:2438, SEQ ID NO:2439, SEQ ID NO:2440, SEQ ID NO:2441, SEQ ID NO:2442, SEQ ID NO:2443, SEQ ID NO:2444, SEQ ID NO:2445, SEQ ID NO:2446, SEQ ID NO:2447, SEQ ID NO:2448, SEQ ID NO:2449, SEQ ID NO:2450, SEQ ID NO:2451, SEQ ID NO:2452, SEQ ID NO:2453, SEQ ID NO:2454, SEQ ID NO:2455, SEQ ID NO:2456, SEQ ID NO:2457, SEQ ID NO:2458, SEQ ID NO:2459, SEQ ID NO:2460, SEQ ID NO:2461, SEQ ID NO:2462, SEQ ID NO:2463, SEQ ID NO:2464, SEQ ID NO:2465, SEQ ID NO:2466, SEQ ID NO:2467, SEQ ID NO:2468, SEQ ID NO:2469, SEQ ID NO:2470, SEQ ID NO:2471, SEQ ID NO:2476, SEQ ID NO:2477, SEQ ID NO:2478, SEQ ID NO:2479, SEQ ID NO:2480, SEQ ID NO:2481, SEQ ID NO:2482, SEQ ID NO:2483, SEQ ID NO:2484, SEQ ID NO:2485, SEQ ID NO:2486, SEQ ID NO:2488, SEQ ID NO:2489, SEQ ID NO:2490, SEQ ID NO:2491, SEQ ID NO:2492, SEQ ID NO:2493, SEQ ID NO:2494, SEQ ID NO:2495, SEQ ID NO:2496, SEQ ID NO:2497, SEQ ID NO:2498, SEQ ID NO:2499, SEQ ID NO:2500, SEQ ID NO:2501, SEQ ID NO:2502, SEQ ID NO:2503, SEQ ID NO:2504, SEQ ID NO:2505, SEQ ID NO:2506, SEQ ID NO:2507, SEQ ID NO:2508, SEQ ID NO:2509, SEQ ID NO:2510, SEQ ID NO:2511, SEQ ID NO:2512, SEQ ID NO:2513, SEQ ID NO:2514, SEQ ID NO:2515, SEQ ID NO:2516, SEQ ID NO:2517, SEQ ID NO:2518, SEQ ID NO:2519, SEQ ID NO:2520, SEQ ID NO:2521, SEQ ID NO:2528, SEQ ID NO:2529, SEQ ID NO:2530, SEQ ID NO:2531, SEQ ID NO:2532, SEQ ID NO:2533, SEQ ID NO:2534, SEQ ID NO:2535, SEQ ID NO:2536, SEQ ID NO:2537, SEQ ID NO:2538, SEQ ID NO:2539, SEQ ID NO:2540, SEQ ID NO:2541, SEQ ID NO:2542, SEQ ID NO:2543, SEQ ID NO:2544, SEQ ID NO:2545, SEQ ID NO:2546, SEQ ID NO:2547, SEQ ID NO:2548, SEQ ID NO:2549, SEQ ID NO:2550, SEQ ID NO:2551, SEQ ID NO:2552, SEQ ID NO:2553, SEQ ID NO:2554, SEQ ID NO:2555, SEQ ID NO:2556, SEQ ID NO:2557, SEQ ID NO:2558, SEQ ID NO:2559, SEQ ID NO:2560, SEQ ID NO:2561, SEQ ID NO:2562, SEQ ID NO:2563, SEQ ID NO:2564, SEQ ID NO:2565, SEQ ID NO:2566, SEQ ID NO:2567, SEQ ID NO:2568, SEQ ID NO:2569, SEQ ID NO:2570, SEQ ID NO:2571, SEQ ID NO:2572, SEQ ID NO:2573, SEQ ID NO:2574, SEQ ID NO:2575, SEQ ID NO:2576, SEQ ID NO:2577, SEQ ID NO:2578, SEQ ID NO:2579, SEQ ID NO:2580, SEQ ID NO:2581, SEQ ID NO:2582, SEQ ID NO:2583, SEQ ID NO:2584, SEQ ID NO:2585, SEQ ID NO:2586, SEQ ID NO:2587, SEQ ID NO:2588, SEQ ID NO:2589, SEQ ID NO:2590, SEQ ID NO:2591, SEQ ID NO:2592, SEQ ID NO:2593, SEQ ID NO:2594, SEQ ID NO:2595, SEQ ID NO:2596, SEQ ID NO:2597, SEQ ID NO:2598, SEQ ID NO:2599, SEQ ID NO:2600, SEQ ID NO:2601, SEQ ID NO:2602, SEQ ID NO:2603, SEQ ID NO:2604, SEQ ID NO:2605, SEQ ID NO:2606, SEQ ID NO:2607, SEQ ID NO:2608, SEQ ID NO:2609, SEQ ID NO:2610, SEQ ID NO:2611, SEQ ID NO:2612, SEQ ID NO:2613, SEQ ID NO:2614, SEQ ID NO:2615, SEQ ID NO:2616, SEQ ID NO:2617, SEQ ID NO:2618, SEQ ID NO:2619, SEQ ID NO:2620, SEQ ID NO:2621, SEQ ID NO:2622, SEQ ID NO:2623, SEQ ID NO:2624, SEQ ID NO:2625, SEQ ID NO:2626. Alternatively, the expression level of the one or more genes may be detected by measuring one or more proteins expressed by one or more genes, and one or more proteins expressed by one or more additional genes. In one variation, the one or more proteins expressed by the one or more genes include an amino acid sequence selected from SEQ ID NO:2400, SEQ ID NO:2401, SEQ ID NO:2402, SEQ ID NO:2403, SEQ ID NO:2404, SEQ ID NO:2405, SEQ ID NO:2407, SEQ ID NO:2408, SEQ ID NO:2409, SEQ ID NO:2410, SEQ ID NO:2411, SEQ ID NO:2412, SEQ ID NO:2413, SEQ ID NO:2414, SEQ ID NO:2415, SEQ ID NO:2416, SEQ ID NO:2417, SEQ ID NO:2418, SEQ ID NO:2419, SEQ ID NO:2420, SEQ ID NO:2421, SEQ ID NO:2422, SEQ ID NO:2423, SEQ ID NO:2424, SEQ ID NO:2425, SEQ ID NO:2426, SEQ ID NO:2427, SEQ ID NO:2428, SEQ ID NO:2429, SEQ ID NO:2430, SEQ ID NO:2432, SEQ ID NO:2433, SEQ ID NO:2434, SEQ ID NO:2435, SEQ ID NO:2436, SEQ ID NO:2437, SEQ ID NO:2438, SEQ ID NO:2439, SEQ ID NO:2440, SEQ ID NO:2441, SEQ ID NO:2442, SEQ ID NO:2443, SEQ ID NO:2444, SEQ ID NO:2445, SEQ ID NO:2446, SEQ ID NO:2447, SEQ ID NO:2448, SEQ ID NO:2449, SEQ ID NO:2450, SEQ ID NO:2451, SEQ ID NO:2452, SEQ ID NO:2453, SEQ ID NO:2454, SEQ ID NO:2455, SEQ ID NO:2456, SEQ ID NO:2457, SEQ ID NO:2458, SEQ ID NO:2459, SEQ ID NO:2460, SEQ ID NO:2461, SEQ ID NO:2462, SEQ ID NO:2463, SEQ ID NO:2464, SEQ ID NO:2465, SEQ ID NO:2466, SEQ ID NO:2467, SEQ ID NO:2468, SEQ ID NO:2469, SEQ ID NO:2470, SEQ ID NO:2471, SEQ ID NO:2476, SEQ ID NO:2477, SEQ ID NO:2478, SEQ ID NO:2479, SEQ ID NO:2480, SEQ ID NO:2481, SEQ ID NO:2482, SEQ ID NO:2483, SEQ ID NO:2484, SEQ ID NO:2485, SEQ ID NO:2486, SEQ ID NO:2488, SEQ ID NO:2489, SEQ ID NO:2490, SEQ ID NO:2491, SEQ ID NO:2492, SEQ ID NO:2493, SEQ ID NO:2494, SEQ ID NO:2495, SEQ ID NO:2496, SEQ ID NO:2497, SEQ ID NO:2498, SEQ ID NO:2499, SEQ ID NO:2500, SEQ ID NO:2501, SEQ ID NO:2502, SEQ ID NO:2503, SEQ ID NO:2504, SEQ ID NO:2505, SEQ ID NO:2506, SEQ ID NO:2507, SEQ ID NO:2508, SEQ ID NO:2509, SEQ ID NO:2510, SEQ ID NO:2511, SEQ ID NO:2512, SEQ ID NO:2513, SEQ ID NO:2514, SEQ ID NO:2515, SEQ ID NO:2516, SEQ ID NO:2517, SEQ ID NO:2518, SEQ ID NO:2519, SEQ ID NO:2520, SEQ ID NO:2521, SEQ ID NO:2528, SEQ ID NO:2529, SEQ ID NO:2530, SEQ ID NO:2531, SEQ ID NO:2532, SEQ ID NO:2533, SEQ ID NO:2534, SEQ ID NO:2535, SEQ ID NO:2536, SEQ ID NO:2537, SEQ ID NO:2538, SEQ ID NO:2539, SEQ ID NO:2540, SEQ ID NO:2541, SEQ ID NO:2542, SEQ ID NO:2543, SEQ ID NO:2544, SEQ ID NO:2545, SEQ ID NO:2546, SEQ ID NO:2547, SEQ ID NO:2548, SEQ ID NO:2549, SEQ ID NO:2550, SEQ ID NO:2551, SEQ ID NO:2552, SEQ ID NO:2553, SEQ ID NO:2554, SEQ ID NO:2555, SEQ ID NO:2556, SEQ ID NO:2557, SEQ ID NO:2558, SEQ ID NO:2559, SEQ ID NO:2560, SEQ ID NO:2561, SEQ ID NO:2562, SEQ ID NO:2563, SEQ ID NO:2564, SEQ ID NO:2565, SEQ ID NO:2566, SEQ ID NO:2567, SEQ ID NO:2568, SEQ ID NO:2569, SEQ ID NO:2570, SEQ ID NO:2571, SEQ ID NO:2572, SEQ ID NO:2573, SEQ ID NO:2574, SEQ ID NO:2575, SEQ ID NO:2576, SEQ ID NO:2577, SEQ ID NO:2578, SEQ ID NO:2579, SEQ ID NO:2580, SEQ ID NO:2581, SEQ ID NO:2582, SEQ ID NO:2583, SEQ ID NO:2584, SEQ ID NO:2585, SEQ ID NO:2586, SEQ ID NO:2587, SEQ ID NO:2588, SEQ ID NO:2589, SEQ ID NO:2590, SEQ ID NO:2591, SEQ ID NO:2592, SEQ ID NO:2593, SEQ ID NO:2594, SEQ ID NO:2595, SEQ ID NO:2596, SEQ ID NO:2597, SEQ ID NO:2598, SEQ ID NO:2599, SEQ ID NO:2600, SEQ ID NO:2601, SEQ ID NO:2602, SEQ ID NO:2603, SEQ ID NO:2604, SEQ ID NO:2605, SEQ ID NO:2606, SEQ ID NO:2607, SEQ ID NO:2608, SEQ ID NO:2609, SEQ ID NO:2610, SEQ ID NO:2611, SEQ ID NO:2612, SEQ ID NO:2613, SEQ ID NO:2614, SEQ ID NO:2615, SEQ ID NO:2616, SEQ ID NO:2617, SEQ ID NO:2618, SEQ ID NO:2619, SEQ ID NO:2620, SEQ ID NO:2621, SEQ ID NO:2622, SEQ ID NO:2623, SEQ ID NO:2624, SEQ ID NO:2625, SEQ ID NO:2626, and the one or more protein expressed by the one or more additional genes include an amino acid sequence selected from the group consisting of SEQ ID NO:2406, SEQ ID NO:2431, SEQ ID NO:2472, SEQ ID NO:2473, SEQ ID NO:2474, SEQ ID NO:2475, SEQ ID NO:2487, SEQ ID NO:2522, SEQ ID NO:2523, SEQ ID NO:2524, SEQ ID NO:2525, SEQ ID NO:2526, SEQ ID NO:2527.

In another aspect, the method of diagnosing or monitoring kidney transplant rejection in a patient includes detecting the expression level of one or more genes in the patient to diagnose or monitor kidney transplant rejection in the patient by measuring one or more proteins encoded by the one or more genes. In one variation, the one or more proteins include an amino acid sequence selected from SEQ ID NO:2400, SEQ ID NO:2401, SEQ ID NO:2402, SEQ ID NO:2403, SEQ ID NO:2404, SEQ ID NO:2405, SEQ ID NO:2406, SEQ ID NO:2407, SEQ ID NO:2408, SEQ ID NO:2409, SEQ ID NO:2410, SEQ ID NO:2411, SEQ ID NO:2412, SEQ ID NO:2413, SEQ ID NO:2414, SEQ ID NO:2415, SEQ ID NO:2416, SEQ ID NO:2417, SEQ ID NO:2418, SEQ ID NO:2419, SEQ ID NO:2420, SEQ ID NO:2421, SEQ ID NO:2422, SEQ ID NO:2423, SEQ ID NO:2424, SEQ ID NO:2425, SEQ ID NO:2426, SEQ ID NO:2427, SEQ ID NO:2428, SEQ ID NO:2429, SEQ ID NO:2430, SEQ ID NO:2432, SEQ ID NO:2433, SEQ ID NO:2434, SEQ ID NO:2435, SEQ ID NO:2436, SEQ ID NO:2437, SEQ ID NO:2438, SEQ ID NO:2439, SEQ ID NO:2440, SEQ ID NO:2441, SEQ ID NO:2442, SEQ ID NO:2443, SEQ ID NO:2444, SEQ ID NO:2445, SEQ ID NO:2446, SEQ ID NO:2447, SEQ ID NO:2448, SEQ ID NO:2449, SEQ ID NO:2450, SEQ ID NO:2451, SEQ ID NO:2452, SEQ ID NO:2453, SEQ ID NO:2454, SEQ ID NO:2455, SEQ ID NO:2456, SEQ ID NO:2457, SEQ ID NO:2458, SEQ ID NO:2459, SEQ ID NO:2460, SEQ ID NO:2461, SEQ ID NO:2462, SEQ ID NO:2463, SEQ ID NO:2464, SEQ ID NO:2465, SEQ ID NO:2466, SEQ ID NO:2467, SEQ ID NO:2468, SEQ ID NO:2469, SEQ ID NO:2470, SEQ ID NO:2474, SEQ ID NO:2478, SEQ ID NO:2479, SEQ ID NO:2480, SEQ ID NO:2481, SEQ ID NO:2482, SEQ ID NO:2483, SEQ ID NO:2485, SEQ ID NO:2486, SEQ ID NO:2487, SEQ ID NO:2488, SEQ ID NO:2491, SEQ ID NO:2492, SEQ ID NO:2493, SEQ ID NO:2494, SEQ ID NO:2495, SEQ ID NO:2496, SEQ ID NO:2497, SEQ ID NO:2502, SEQ ID NO:2503, SEQ ID NO:2504, SEQ ID NO:2505, SEQ ID NO:2506, SEQ ID NO:2507, SEQ ID NO:2508, SEQ ID NO:2509, SEQ ID NO:2510, SEQ ID NO:2511, SEQ ID NO:2512, SEQ ID NO:2513, SEQ ID NO:2514, SEQ ID NO:2515, SEQ ID NO:2516, SEQ ID NO:2517, SEQ ID NO:2518, SEQ ID NO:2519, SEQ ID NO:2520, SEQ ID NO:2521, SEQ ID NO:2528, SEQ ID NO:2529, SEQ ID NO:2530, SEQ ID NO:2531, SEQ ID NO:2532, SEQ ID NO:2533, SEQ ID NO:2534, SEQ ID NO:2535, SEQ ID NO:2536, SEQ ID NO:2537, SEQ ID NO:2538, SEQ ID NO:2539, SEQ ID NO:2540, SEQ ID NO:2541, SEQ ID NO:2542, SEQ ID NO:2543, SEQ ID NO:2544, SEQ ID NO:2545, SEQ ID NO:2546, SEQ ID NO:2547, SEQ ID NO:2548, SEQ ID NO:2549, SEQ ID NO:2550, SEQ ID NO:2551, SEQ ID NO:2552, SEQ ID NO:2553, SEQ ID NO:2554, SEQ ID NO:2555, SEQ ID NO:2556, SEQ ID NO:2557, SEQ ID NO:2558, SEQ ID NO:2559, SEQ ID NO:2560, SEQ ID NO:2561, SEQ ID NO:2562, SEQ ID NO:2563, SEQ ID NO:2564, SEQ ID NO:2565, SEQ ID NO:2566, SEQ ID NO:2567, SEQ ID NO:2568, SEQ ID NO:2569, SEQ ID NO:2570, SEQ ID NO:2571, SEQ ID NO:2572, SEQ ID NO:2573, SEQ ID NO:2574, SEQ ID NO:2575, SEQ ID NO:2576, SEQ ID NO:2577, SEQ ID NO:2578, SEQ ID NO:2579, SEQ ID NO:2580, SEQ ID NO:2581, SEQ ID NO:2582, SEQ ID NO:2583, SEQ ID NO:2584, SEQ ID NO:2585, SEQ ID NO:2586, SEQ ID NO:2587, SEQ ID NO:2588, SEQ ID NO:2589, SEQ ID NO:2590, SEQ ID NO:2591, SEQ ID NO:2592, SEQ ID NO:2593, SEQ ID NO:2594, SEQ ID NO:2595, SEQ ID NO:2596, SEQ ID NO:2597, SEQ ID NO:2598, SEQ ID NO:2599, SEQ ID NO:2600, SEQ ID NO:2601, SEQ ID NO:2602, SEQ ID NO:2603, SEQ ID NO:2604, SEQ ID NO:2605, SEQ ID NO:2606, SEQ ID NO:2607, SEQ ID NO:2608, SEQ ID NO:2609, SEQ ID NO:2610, SEQ ID NO:2611, SEQ ID NO:2612, SEQ ID NO:2613, SEQ ID NO:2614, SEQ ID NO:2615, SEQ ID NO:2616, SEQ ID NO:2617, SEQ ID NO:2618, SEQ ID NO:2619, SEQ ID NO:2620, SEQ ID NO:2621, SEQ ID NO:2622, SEQ ID NO:2623, SEQ ID NO:2624, SEQ ID NO:2625, SEQ ID NO:2626, SEQ ID NO:2925, SEQ ID NO:2926, SEQ ID NO:2927, SEQ ID NO:2928, SEQ ID NO:2929, SEQ ID NO:2930, SEQ ID NO:2932, SEQ ID NO:2933, SEQ ID NO:2935, SEQ ID NO:2936, SEQ ID NO:2937, SEQ ID NO:2938, SEQ ID NO:2939, SEQ ID NO:2941, SEQ ID NO:2942, SEQ ID NO:2943, SEQ ID NO:2945, SEQ ID NO:2946, SEQ ID NO:2947, SEQ ID NO:2948, SEQ ID NO:2949, SEQ ID NO:2950, SEQ ID NO:2951, SEQ ID NO:2952, SEQ ID NO:2953, SEQ ID NO:2954, SEQ ID NO:2955, SEQ ID NO:2956, SEQ ID NO:2957, SEQ ID NO:2959, SEQ ID NO:2960, SEQ ID NO:2961, SEQ ID NO:2962, SEQ ID NO:2963, SEQ ID NO:2964, SEQ ID NO:2965, SEQ ID NO:2966, SEQ ID NO:2967, SEQ ID NO:2968, SEQ ID NO:2969, SEQ ID NO:2970, SEQ ID NO:2971, SEQ ID NO:2972, SEQ ID NO:2973, SEQ ID NO:2974, SEQ ID NO:2975, SEQ ID NO:2976, SEQ ID NO:2977, SEQ ID NO:2978, SEQ ID NO:2979, SEQ ID NO:2980, SEQ ID NO:2981, SEQ ID NO:2982, SEQ ID NO:2983, SEQ ID NO:2984, SEQ ID NO:2985, SEQ ID NO:2986, SEQ ID NO:2987, SEQ ID NO:2988, SEQ ID NO:2989, SEQ ID NO:2990, SEQ ID NO:2991, SEQ ID NO:2992, SEQ ID NO:2993, SEQ ID NO:2994, SEQ ID NO:2995, SEQ ID NO:2996, SEQ ID NO:2997, SEQ ID NO:2998, SEQ ID NO:2999, SEQ ID NO:3000, SEQ ID NO:3001, SEQ ID NO:3002, SEQ ID NO:3003, SEQ ID NO:3004, SEQ ID NO:3005, SEQ ID NO:3006, SEQ ID NO:3007, SEQ ID NO:3008, SEQ ID NO:3009, SEQ ID NO:3010, SEQ ID NO:3011, SEQ ID NO:3012, SEQ ID NO:3013, SEQ ID NO:3014, SEQ ID NO:3015. In another variation, the method includes detecting the expression level of one or more additional genes by measuring one or more proteins expressed by the one or more additional genes. The one or more proteins expressed by the one or more genes comprises an amino acid sequence selected from SEQ ID NO:2400, SEQ ID NO:2401, SEQ ID NO:2402, SEQ ID NO:2403, SEQ ID NO:2404, SEQ ID NO:2405, SEQ ID NO:2406, SEQ ID NO:2407, SEQ ID NO:2408, SEQ ID NO:2409, SEQ ID NO:2410, SEQ ID NO:2411, SEQ ID NO:2412, SEQ ID NO:2413, SEQ ID NO:2414, SEQ ID NO:2415, SEQ ID NO:2416, SEQ ID NO:2417, SEQ ID NO:2418, SEQ ID NO:2419, SEQ ID NO:2420, SEQ ID NO:2421, SEQ ID NO:2422, SEQ ID NO:2423, SEQ ID NO:2424, SEQ ID NO:2425, SEQ ID NO:2426, SEQ ID NO:2427, SEQ ID NO:2428, SEQ ID NO:2429, SEQ ID NO:2430, SEQ ID NO:2432, SEQ ID NO:2433, SEQ ID NO:2434, SEQ ID NO:2435, SEQ ID NO:2436, SEQ ID NO:2437, SEQ ID NO:2438, SEQ ID NO:2439, SEQ ID NO:2440, SEQ ID NO:2441, SEQ ID NO:2442, SEQ ID NO:2443, SEQ ID NO:2444, SEQ ID NO:2445, SEQ ID NO:2446, SEQ ID NO:2447, SEQ ID NO:2448, SEQ ID NO:2449, SEQ ID NO:2450, SEQ ID NO:2451, SEQ ID NO:2452, SEQ ID NO:2453, SEQ ID NO:2454, SEQ ID NO:2455, SEQ ID NO:2456, SEQ ID NO:2457, SEQ ID NO:2458, SEQ ID NO:2459, SEQ ID NO:2460, SEQ ID NO:2461, SEQ ID NO:2462, SEQ ID NO:2463, SEQ ID NO:2464, SEQ ID NO:2465, SEQ ID NO:2466, SEQ ID NO:2467, SEQ ID NO:2468, SEQ ID NO:2469, SEQ ID NO:2470, SEQ ID NO:2474, SEQ ID NO:2478, SEQ ID NO:2479, SEQ ID NO:2480, SEQ ID NO:2481, SEQ ID NO:2482, SEQ ID NO:2483, SEQ ID NO:2485, SEQ ID NO:2486, SEQ ID NO:2487, SEQ ID NO:2488, SEQ ID NO:2491, SEQ ID NO:2492, SEQ ID NO:2493, SEQ ID NO:2494, SEQ ID NO:2495, SEQ ID NO:2496, SEQ ID NO:2497, SEQ ID NO:2502, SEQ ID NO:2503, SEQ ID NO:2504, SEQ ID NO:2505, SEQ ID NO:2506, SEQ ID NO:2507, SEQ ID NO:2508, SEQ ID NO:2509, SEQ ID NO:2510, SEQ ID NO:2511, SEQ ID NO:2512, SEQ ID NO:2513, SEQ ID NO:2514, SEQ ID NO:2515, SEQ ID NO:2516, SEQ ID NO:2517, SEQ ID NO:2518, SEQ ID NO:2519, SEQ ID NO:2520, SEQ ID NO:2521, SEQ ID NO:2528, SEQ ID NO:2529, SEQ ID NO:2530, SEQ ID NO:2531, SEQ ID NO:2532, SEQ ID NO:2533, SEQ ID NO:2534, SEQ ID NO:2535, SEQ ID NO:2536, SEQ ID NO:2537, SEQ ID NO:2538, SEQ ID NO:2539, SEQ ID NO:2540, SEQ ID NO:2541, SEQ ID NO:2542, SEQ ID NO:2543, SEQ ID NO:2544, SEQ ID NO:2545, SEQ ID NO:2546, SEQ ID NO:2547, SEQ ID NO:2548, SEQ ID NO:2549, SEQ ID NO:2550, SEQ ID NO:2551, SEQ ID NO:2552, SEQ ID NO:2553, SEQ ID NO:2554, SEQ ID NO:2555, SEQ ID NO:2556, SEQ ID NO:2557, SEQ ID NO:2558, SEQ ID NO:2559, SEQ ID NO:2560, SEQ ID NO:2561, SEQ ID NO:2562, SEQ ID NO:2563, SEQ ID NO:2564, SEQ ID NO:2565, SEQ ID NO:2566, SEQ ID NO:2567, SEQ ID NO:2568, SEQ ID NO:2569, SEQ ID NO:2570, SEQ ID NO:2571, SEQ ID NO:2572, SEQ ID NO:2573, SEQ ID NO:2574, SEQ ID NO:2575, SEQ ID NO:2576, SEQ ID NO:2577, SEQ ID NO:2578, SEQ ID NO:2579, SEQ ID NO:2580, SEQ ID NO:2581, SEQ ID NO:2582, SEQ ID NO:2583, SEQ ID NO:2584, SEQ ID NO:2585, SEQ ID NO:2586, SEQ ID NO:2587, SEQ ID NO:2588, SEQ ID NO:2589, SEQ ID NO:2590, SEQ ID NO:2591, SEQ ID NO:2592, SEQ ID NO:2593, SEQ ID NO:2594, SEQ ID NO:2595, SEQ ID NO:2596, SEQ ID NO:2597, SEQ ID NO:2598, SEQ ID NO:2599, SEQ ID NO:2600, SEQ ID NO:2601, SEQ ID NO:2602, SEQ ID NO:2603, SEQ ID NO:2604, SEQ ID NO:2605, SEQ ID NO:2606, SEQ ID NO:2607, SEQ ID NO:2608, SEQ ID NO:2609, SEQ ID NO:2610, SEQ ID NO:2611, SEQ ID NO:2612, SEQ ID NO:2613, SEQ ID NO:2614, SEQ ID NO:2615, SEQ ID NO:2616, SEQ ID NO:2617, SEQ ID NO:2618, SEQ ID NO:2619, SEQ ID NO:2620, SEQ ID NO:2621, SEQ ID NO:2622, SEQ ID NO:2623, SEQ ID NO:2624, SEQ ID NO:2625, SEQ ID NO:2626, SEQ ID NO:2925, SEQ ID NO:2926, SEQ ID NO:2927, SEQ ID NO:2928, SEQ ID NO:2929, SEQ ID NO:2930, SEQ ID NO:2932, SEQ ID NO:2933, SEQ ID NO:2935, SEQ ID NO:2936, SEQ ID NO:2937, SEQ ID NO:2938, SEQ ID NO:2939, SEQ ID NO:2941, SEQ ID NO:2942, SEQ ID NO:2943, SEQ ID NO:2945, SEQ ID NO:2946, SEQ ID NO:2947, SEQ ID NO:2948, SEQ ID NO:2949, SEQ ID NO:2950, SEQ ID NO:2951, SEQ ID NO:2952, SEQ ID NO:2953, SEQ ID NO:2954, SEQ ID NO:2955, SEQ ID NO:2956, SEQ ID NO:2957, SEQ ID NO:2959, SEQ ID NO:2960, SEQ ID NO:2961, SEQ ID NO:2962, SEQ ID NO:2963, SEQ ID NO:2964, SEQ ID NO:2965, SEQ ID NO:2966, SEQ ID NO:2967, SEQ ID NO:2968, SEQ ID NO:2969, SEQ ID NO:2970, SEQ ID NO:2971, SEQ ID NO:2972, SEQ ID NO:2973, SEQ ID NO:2974, SEQ ID NO:2975, SEQ ID NO:2976, SEQ ID NO:2977, SEQ ID NO:2978, SEQ ID NO:2979, SEQ ID NO:2980, SEQ ID NO:2981, SEQ ID NO:2982, SEQ ID NO:2983, SEQ ID NO:2984, SEQ ID NO:2985, SEQ ID NO:2986, SEQ ID NO:2987, SEQ ID NO:2988, SEQ ID NO:2989, SEQ ID NO:2990, SEQ ID NO:2991, SEQ ID NO:2992, SEQ ID NO:2993, SEQ ID NO:2994, SEQ ID NO:2995, SEQ ID NO:2996, SEQ ID NO:2997, SEQ ID NO:2998, SEQ ID NO:2999, SEQ ID NO:3000, SEQ ID NO:3001, SEQ ID NO:3002, SEQ ID NO:3003, SEQ ID NO:3004, SEQ ID NO:3005, SEQ ID NO:3006, SEQ ID NO:3007, SEQ ID NO:3008, SEQ ID NO:3009, SEQ ID NO:3010, SEQ ID NO:3011, SEQ ID NO:3012, SEQ ID NO:3013, SEQ ID NO:3014, SEQ ID NO:3015, and the one or more proteins expressed by the one or more additional genes may include an amino acid sequence selected from SEQ ID NO:2431, SEQ ID NO:2471, SEQ ID NO:2472, SEQ ID NO:2473, SEQ ID NO:2475, SEQ ID NO:2476, SEQ ID NO:2477, SEQ ID NO:2484, SEQ ID NO:2489, SEQ ID NO:2490, SEQ ID NO:2498, SEQ ID NO:2499, SEQ ID NO:2500, SEQ ID NO:2501, SEQ ID NO:2522, SEQ ID NO:2523, SEQ ID NO:2524, SEQ ID NO:2525, SEQ ID NO:2526, SEQ ID NO:2527.

Protein detection may be accomplished by measuring serum. In another variation, the protein is a cell surface protein. In a further variation, the measuring includes using a fluorescent activated cell sorter.

In another aspect, the invention is directed to a substantially purified oligonucleotide having the nucleotide sequence selected from SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, SEQ ID NO:97, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:140, SEQ ID NO:141, SEQ ID NO:142, SEQ ID NO:143, SEQ ID NO:144, SEQ ID NO:145, SEQ ID NO:146, SEQ ID NO:147, SEQ ID NO:148, SEQ ID NO:149, SEQ ID NO:150, SEQ ID NO:151, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:173, SEQ ID NO:174, SEQ ID NO:175, SEQ ID NO:176, SEQ ID NO:177, SEQ ID NO:178, SEQ ID NO:179, SEQ ID NO:180, SEQ ID NO:181, SEQ ID NO:182, SEQ ID NO:183, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, SEQ ID NO:217, SEQ ID NO:218, SEQ ID NO:219, SEQ ID NO:220, SEQ ID NO:221, SEQ ID NO:222, SEQ ID NO:223, SEQ ID NO:224, SEQ ID NO:225, SEQ ID NO:226, SEQ ID NO:227, SEQ ID NO:228, SEQ ID NO:229, SEQ ID NO:230, SEQ ID NO:231, SEQ ID NO:232, SEQ ID NO:233, SEQ ID NO:234, SEQ ID
NO:235, SEQ ID NO:236, SEQ ID NO:237, SEQ ID
NO:238, SEQ ID NO:239, SEQ ID NO:240, SEQ ID
NO:241, SEQ ID NO:242, SEQ ID NO:243, SEQ ID
NO:244, SEQ ID NO:245, SEQ ID NO:246, SEQ ID
NO:247, SEQ ID NO:248, SEQ ID NO:249, SEQ ID
NO:250, SEQ ID NO:251, SEQ ID NO:252, SEQ ID
NO:253, SEQ ID NO:254, SEQ ID NO:255, SEQ ID
NO:256, SEQ ID NO:257, SEQ ID NO:258, SEQ ID
NO:259, SEQ ID NO:260, SEQ ID NO:261, SEQ ID
NO:262, SEQ ID NO:263, SEQ ID NO:264, SEQ ID
NO:265, SEQ ID NO:266, SEQ ID NO:267, SEQ ID
NO:268, SEQ ID NO:269, SEQ ID NO:270, SEQ ID
NO:271, SEQ ID NO:272, SEQ ID NO:273, SEQ ID
NO:274, SEQ ID NO:275, SEQ ID NO:276, SEQ ID
NO:277, SEQ ID NO:278, SEQ ID NO:279, SEQ ID
NO:280, SEQ ID NO:281, SEQ ID NO:282, SEQ ID
NO:283, SEQ ID NO:284, SEQ ID NO:285, SEQ ID
NO:286, SEQ ID NO:287, SEQ ID NO:288, SEQ ID
NO:289, SEQ ID NO:290, SEQ ID NO:291, SEQ ID
NO:292, SEQ ID NO:293, SEQ ID NO:294, SEQ ID
NO:295, SEQ ID NO:296, SEQ ID NO:297, SEQ ID
NO:298, SEQ ID NO:299, SEQ ID NO:300, SEQ ID
NO:301, SEQ ID NO:302, SEQ ID NO:303, SEQ ID
NO:304, SEQ ID NO:305, SEQ ID NO:306, SEQ ID
NO:307, SEQ ID NO:308, SEQ ID NO:309, SEQ ID
NO:310, SEQ ID NO:311, SEQ ID NO:312, SEQ ID
NO:313, SEQ ID NO:314, SEQ ID NO:315, SEQ ID
NO:316, SEQ ID NO:317, SEQ ID NO:318, SEQ ID
NO:319, SEQ ID NO:320, SEQ ID NO:321, SEQ ID
NO:322, SEQ ID NO:323, SEQ ID NO:324, SEQ ID
NO:325, SEQ ID NO:326, SEQ ID NO:327, SEQ ID
NO:328, SEQ ID NO:329, SEQ ID NO:330, SEQ ID
NO:331, SEQ ID NO:332, SEQ ID NO:2697, SEQ ID
NO:2645, SEQ ID NO:2707, SEQ ID NO:2679, SEQ ID
NO:2717, SEQ ID NO:2646, SEQ ID NO:2667, SEQ ID
NO:2706, SEQ ID NO:2740, SEQ ID NO:2669, SEQ ID
NO:2674, SEQ ID NO:2743, SEQ ID NO:2716, SEQ ID
NO:2727, SEQ ID NO:2721, SEQ ID NO:2641, SEQ ID
NO:2671, SEQ ID NO:2752, SEQ ID NO:2737, SEQ ID
NO:2719, SEQ ID NO:2684, SEQ ID NO:2677, SEQ ID
NO:2748, SEQ ID NO:2703, SEQ ID NO:2711, SEQ ID
NO:2663, SEQ ID NO:2657, SEQ ID NO:2683, SEQ ID
NO:2686, SEQ ID NO:2687, SEQ ID NO:2644, SEQ ID
NO:2664, SEQ ID NO:2747, SEQ ID NO:2744, SEQ ID
NO:2678, SEQ ID NO:2731, SEQ ID NO:2713, SEQ ID
NO:2736, SEQ ID NO:2708, SEQ ID NO:2670, SEQ ID
NO:2661, SEQ ID NO:2680, SEQ ID NO:2754, SEQ ID
NO:2728, SEQ ID NO:2742, SEQ ID NO:2668, SEQ ID
NO:2750, SEQ ID NO:2746, SEQ ID NO:2738, SEQ ID
NO:2627, SEQ ID NO:2739, SEQ ID NO:2647, SEQ ID
NO:2628, SEQ ID NO:2638, SEQ ID NO:2725, SEQ ID
NO:2714, SEQ ID NO:2635, SEQ ID NO:2751, SEQ ID
NO:2629, SEQ ID NO:2695, SEQ ID NO:2741, SEQ ID
NO:2691, SEQ ID NO:2726, SEQ ID NO:2722, SEQ ID
NO:2689, SEQ ID NO:2734, SEQ ID NO:2631, SEQ ID
NO:2656, SEQ ID NO:2696, SEQ ID NO:2676, SEQ ID
NO:2701, SEQ ID NO:2730, SEQ ID NO:2710, SEQ ID
NO:2632, SEQ ID NO:2724, SEQ ID NO:2698, SEQ ID
NO:2662, SEQ ID NO:2753, SEQ ID NO:2704, SEQ ID
NO:2675, SEQ ID NO:2700, SEQ ID NO:2640, SEQ ID
NO:2723, SEQ ID NO:2658, SEQ ID NO:2688, SEQ ID
NO:2735, SEQ ID NO:2702, SEQ ID NO:2681, SEQ ID
NO:2755, SEQ ID NO:2715, SEQ ID NO:2732, SEQ ID
NO:2652, SEQ ID NO:2651, SEQ ID NO:2718, SEQ ID
NO:2673, SEQ ID NO:2733, SEQ ID NO:2712, SEQ ID
NO:2659, SEQ ID NO:2654, SEQ ID NO:2636, SEQ ID
NO:2639, SEQ ID NO:2690, SEQ ID NO:2705, SEQ ID
NO:2685, SEQ ID NO:2692, SEQ ID NO:2693, SEQ ID
NO:2648, SEQ ID NO:2650, SEQ ID NO:2720, SEQ ID
NO:2660, SEQ ID NO:2666, SEQ ID NO:2699, SEQ ID
NO:2633, SEQ ID NO:2672, SEQ ID NO:2642, SEQ ID
NO:2682, SEQ ID NO:2655, SEQ ID NO:2630, SEQ ID
NO:2745, SEQ ID NO:2643, SEQ ID NO:2694, SEQ ID
NO:2749, SEQ ID NO:2665, SEQ ID NO:2649, SEQ ID
NO:2637, SEQ ID NO:2634, SEQ ID NO:2709, SEQ ID
NO:2653, SEQ ID NO:2729, a substantially purified oligonucleotide having the nucleotide sequence selected from SEQ ID NO:333-664, and substantially purified oligonucleotides having at least 90% sequence identity to an oligonucleotide having the nucleotide sequence selected from SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, SEQ ID NO:97, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:140, SEQ ID NO:141, SEQ ID NO:142, SEQ ID NO:143, SEQ ID NO:144, SEQ ID NO:145, SEQ ID NO:146, SEQ ID NO:147, SEQ ID NO:148, SEQ ID NO:149, SEQ ID NO:150, SEQ ID NO:151, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:173, SEQ ID NO:174, SEQ ID NO:175, SEQ ID NO:176, SEQ ID NO:177, SEQ ID NO:178, SEQ ID
NO:179, SEQ ID NO:180, SEQ ID NO:181, SEQ ID
NO:182, SEQ ID NO:183, SEQ ID NO:184, SEQ ID
NO:185, SEQ ID NO:186, SEQ ID NO:187, SEQ ID
NO:188, SEQ ID NO:189, SEQ ID NO:190, SEQ ID
NO:191, SEQ ID NO:192, SEQ ID NO:193, SEQ ID
NO:194, SEQ ID NO:195, SEQ ID NO:196, SEQ ID
NO:197, SEQ ID NO:198, SEQ ID NO:199, SEQ ID
NO:200, SEQ ID NO:201, SEQ ID NO:202, SEQ ID
NO:203, SEQ ID NO:204, SEQ ID NO:205, SEQ ID
NO:206, SEQ ID NO:207, SEQ ID NO:208, SEQ ID
NO:209, SEQ ID NO:210, SEQ ID NO:211, SEQ ID
NO:212, SEQ ID NO:213, SEQ ID NO:214, SEQ ID
NO:215, SEQ ID NO:216, SEQ ID NO:217, SEQ ID
NO:218, SEQ ID NO:219, SEQ ID NO:220, SEQ ID
NO:221, SEQ ID NO:222, SEQ ID NO:223, SEQ ID
NO:224, SEQ ID NO:225, SEQ ID NO:226, SEQ ID
NO:227, SEQ ID NO:228, SEQ ID NO:229, SEQ ID
NO:230, SEQ ID NO:231, SEQ ID NO:232, SEQ ID
NO:233, SEQ ID NO:234, SEQ ID NO:235, SEQ ID
NO:236, SEQ ID NO:237, SEQ ID NO:238, SEQ ID
NO:239, SEQ ID NO:240, SEQ ID NO:241, SEQ ID
NO:242, SEQ ID NO:243, SEQ ID NO:244, SEQ ID
NO:245, SEQ ID NO:246, SEQ ID NO:247, SEQ ID
NO:248, SEQ ID NO:249, SEQ ID NO:250, SEQ ID
NO:251, SEQ ID NO:252, SEQ ID NO:253, SEQ ID
NO:254, SEQ ID NO:255, SEQ ID NO:256, SEQ ID
NO:257, SEQ ID NO:258, SEQ ID NO:259, SEQ ID
NO:260, SEQ ID NO:261, SEQ ID NO:262, SEQ ID
NO:263, SEQ ID NO:264, SEQ ID NO:265, SEQ ID
NO:266, SEQ ID NO:267, SEQ ID NO:268, SEQ ID
NO:269, SEQ ID NO:270, SEQ ID NO:271, SEQ ID
NO:272, SEQ ID NO:273, SEQ ID NO:274, SEQ ID
NO:275, SEQ ID NO:276, SEQ ID NO:277, SEQ ID
NO:278, SEQ ID NO:279, SEQ ID NO:280, SEQ ID
NO:281, SEQ ID NO:282, SEQ ID NO:283, SEQ ID
NO:284, SEQ ID NO:285, SEQ ID NO:286, SEQ ID
NO:287, SEQ ID NO:288, SEQ ID NO:289, SEQ ID
NO:290, SEQ ID NO:291, SEQ ID NO:292, SEQ ID
NO:293, SEQ ID NO:294, SEQ ID NO:295, SEQ ID
NO:296, SEQ ID NO:297, SEQ ID NO:298, SEQ-ID
NO:299, SEQ ID NO:300, SEQ ID NO:301, SEQ ID
NO:302, SEQ ID NO:303, SEQ ID NO:304, SEQ ID
NO:305, SEQ ID NO:306, SEQ ID NO:307, SEQ ID
NO:308, SEQ ID NO:309, SEQ ID NO:310, SEQ ID
NO:311, SEQ ID NO:312, SEQ ID NO:313, SEQ ID
NO:314, SEQ ID NO:315, SEQ ID NO:316, SEQ ID
NO:317, SEQ ID NO:318, SEQ ID NO:319, SEQ ID
NO:320, SEQ ID NO:321, SEQ ID NO:322, SEQ ID
NO:323, SEQ ID NO:324, SEQ ID NO:325, SEQ ID
NO:326, SEQ ID NO:327, SEQ ID NO:328, SEQ ID
NO:329, SEQ ID NO:330, SEQ ID NO:331, SEQ ID
NO:332, SEQ ID NO:2697, SEQ ID NO:2645, SEQ ID
NO:2707, SEQ ID NO:2679, SEQ ID NO:2717, SEQ ID
NO:2646, SEQ ID NO:2667, SEQ ID NO:2706, SEQ ID
NO:2740, SEQ ID NO:2669, SEQ ID NO:2674, SEQ ID
NO:2743, SEQ ID NO:2716, SEQ ID NO:2727, SEQ ID
NO:2721, SEQ ID NO:2641, SEQ ID NO:2671, SEQ ID
NO:2752, SEQ ID NO:2737, SEQ ID NO:2719, SEQ ID
NO:2684, SEQ ID NO:2677, SEQ ID NO:2748, SEQ ID
NO:2703, SEQ ID NO:2711, SEQ ID NO:2663, SEQ ID
NO:2657, SEQ ID NO:2683, SEQ ID NO:2686, SEQ ID
NO:2687, SEQ ID NO:2644, SEQ ID NO:2664, SEQ ID
NO:2747, SEQ ID NO:2744, SEQ ID NO:2678, SEQ ID
NO:2731, SEQ ID NO:2713, SEQ ID NO:2736, SEQ ID
NO:2708, SEQ ID NO:2670, SEQ ID NO:2661, SEQ ID
NO:2680, SEQ ID NO:2754, SEQ ID NO:2728, SEQ ID
NO:2742, SEQ ID NO:2668, SEQ ID NO:2750, SEQ ID
NO:2746, SEQ ID NO:2738, SEQ ID NO:2627, SEQ ID
NO:2739, SEQ ID NO:2647, SEQ ID NO:2628, SEQ ID
NO:2638, SEQ ID NO:2725, SEQ ID NO:2714, SEQ ID
NO:2635, SEQ ID NO:2751, SEQ ID NO:2629, SEQ ID
NO:2695, SEQ ID NO:2741, SEQ ID NO:2691, SEQ ID
NO:2726, SEQ ID NO:2722, SEQ ID NO:2689, SEQ ID
NO:2734, SEQ ID NO:2631, SEQ ID NO:2656, SEQ ID
NO:2696, SEQ ID NO:2676, SEQ ID NO:2701, SEQ ID
NO:2730, SEQ ID NO:2710, SEQ ID NO:2632, SEQ ID
NO:2724, SEQ ID NO:2698, SEQ ID NO:2662, SEQ ID
NO:2753, SEQ ID NO:2704, SEQ ID NO:2675, SEQ ID
NO:2700, SEQ ID NO:2640, SEQ ID NO:2723, SEQ ID
NO:2658, SEQ ID NO:2688, SEQ ID NO:2735, SEQ ID
NO:2702, SEQ ID NO:2681, SEQ ID NO:2755, SEQ ID
NO:2715, SEQ ID NO:2732, SEQ ID NO:2652, SEQ ID
NO:2651, SEQ ID NO:2718, SEQ ID NO:2673, SEQ ID
NO:2733, SEQ ID NO:2712, SEQ ID NO:2659, SEQ ID
NO:2654, SEQ ID NO:2636, SEQ ID NO:2639, SEQ ID
NO:2690, SEQ ID NO:2705, SEQ ID NO:2685, SEQ ID
NO:2692, SEQ ID NO:2693, SEQ ID NO:2648, SEQ ID
NO:2650, SEQ ID NO:2720, SEQ ID NO:2660, SEQ ID
NO:2666, SEQ ID NO:2699, SEQ ID NO:2633, SEQ ID
NO:2672, SEQ ID NO:2642, SEQ ID NO:2682, SEQ ID
NO:2655, SEQ ID NO:2630, SEQ ID NO:2745, SEQ ID
NO:2643, SEQ ID NO:2694, SEQ ID NO:2749, SEQ ID
NO:2665, SEQ ID NO:2649, SEQ ID NO:2637, SEQ ID
NO:2634, SEQ ID NO:2709, SEQ ID NO:2653, SEQ ID
NO:2729 and/or SEQ ID NO:333-664. In a further aspect, the invention is directed to a substantially purified oligonucleotide that hybridizes at high stringency to an oligonucleotide having the nucleotide sequence selected from SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, SEQ ID NO:97, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:140, SEQ ID NO:141, SEQ ID NO:142, SEQ ID NO:143, SEQ ID NO:144, SEQ ID NO:145, SEQ ID NO:146, SEQ ID NO:147, SEQ ID NO:148, SEQ ID NO:149, SEQ ID NO:150, SEQ ID NO:151, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:173, SEQ ID NO:174, SEQ ID NO:175, SEQ ID NO:176, SEQ ID NO:177, SEQ ID NO:178, SEQ ID NO:179, SEQ ID NO:180, SEQ ID NO:181, SEQ ID NO:182, SEQ ID NO:183, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, SEQ ID NO:217, SEQ ID NO:218, SEQ ID NO:219, SEQ ID NO:220, SEQ ID NO:221, SEQ ID NO:222, SEQ ID NO:223, SEQ ID NO:224, SEQ ID NO:225, SEQ ID NO:226, SEQ ID NO:227, SEQ ID NO:228, SEQ ID NO:229, SEQ ID NO:230, SEQ ID NO:231, SEQ ID NO:232, SEQ ID NO:233, SEQ ID NO:234, SEQ ID NO:235, SEQ ID NO:236, SEQ ID NO:237, SEQ ID NO:238, SEQ ID NO:239, SEQ ID NO:240, SEQ ID NO:241, SEQ ID NO:242, SEQ ID NO:243, SEQ ID NO:244, SEQ ID NO:245, SEQ ID NO:246, SEQ ID NO:247, SEQ ID NO:248, SEQ ID NO:249, SEQ ID NO:250, SEQ ID NO:251, SEQ ID NO:252, SEQ ID NO:253, SEQ ID NO:254, SEQ ID NO:255, SEQ ID NO:256, SEQ ID NO:257, SEQ ID NO:258, SEQ ID NO:259, SEQ ID NO:260, SEQ ID NO:261, SEQ ID NO:262, SEQ ID NO:263, SEQ ID NO:264, SEQ ID NO:265, SEQ ID NO:266, SEQ ID NO:267, SEQ ID NO:268, SEQ ID NO:269, SEQ ID NO:270, SEQ ID NO:271, SEQ ID NO:272, SEQ ID NO:273, SEQ ID NO:274, SEQ ID NO:275, SEQ ID NO:276, SEQ ID NO:277, SEQ ID NO:278, SEQ ID NO:279, SEQ ID NO:280, SEQ ID NO:281, SEQ ID NO:282, SEQ ID NO:283, SEQ ID NO:284, SEQ ID NO:285, SEQ ID NO:286, SEQ ID NO:287, SEQ ID NO:288, SEQ ID NO:289, SEQ ID NO:290, SEQ ID NO:291, SEQ ID NO:292, SEQ ID NO:293, SEQ ID NO:294, SEQ ID NO:295, SEQ ID NO:296, SEQ ID NO:297, SEQ ID NO:298, SEQ ID NO:299, SEQ ID NO:300, SEQ ID NO:301, SEQ ID NO:302, SEQ ID NO:303, SEQ ID NO:304, SEQ ID NO:305, SEQ ID NO:306, SEQ ID NO:307, SEQ ID NO:308, SEQ ID NO:309, SEQ ID NO:310, SEQ ID NO:311, SEQ ID NO:312, SEQ ID NO:313, SEQ ID NO:314, SEQ ID NO:315, SEQ ID NO:316, SEQ ID NO:317, SEQ ID NO:318, SEQ ID NO:319, SEQ ID NO:320, SEQ ID NO:321, SEQ ID NO:322, SEQ ID NO:323, SEQ ID NO:324, SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:2697, SEQ ID NO:2645, SEQ ID NO:2707, SEQ ID NO:2679, SEQ ID NO:2717, SEQ ID NO:2646, SEQ ID NO:2667, SEQ ID NO:2706, SEQ ID NO:2740, SEQ ID NO:2669, SEQ ID NO:2674, SEQ ID NO:2743, SEQ ID NO:2716, SEQ ID NO:2727, SEQ ID NO:2721, SEQ ID NO:2641, SEQ ID NO:2671, SEQ ID NO:2752, SEQ ID NO:2737, SEQ ID NO:2719, SEQ ID NO:2684, SEQ ID NO:2677, SEQ ID NO:2748, SEQ ID NO:2703, SEQ ID NO:2711, SEQ ID NO:2663, SEQ ID NO:2657, SEQ ID NO:2683, SEQ ID NO:2686, SEQ ID NO:2687, SEQ ID NO:2644, SEQ ID NO:2664, SEQ ID NO:2747, SEQ ID NO:2744, SEQ ID NO:2678, SEQ ID NO:2731, SEQ ID NO:2713, SEQ ID NO:2736, SEQ ID NO:2708, SEQ ID NO:2670, SEQ ID NO:2661, SEQ ID NO:2680, SEQ ID NO:2754, SEQ ID NO:2728, SEQ ID NO:2742, SEQ ID NO:2668, SEQ ID NO:2750, SEQ ID NO:2746, SEQ ID NO:2738, SEQ ID NO:2627, SEQ ID NO:2739, SEQ ID NO:2647, SEQ ID NO:2628, SEQ ID NO:2638, SEQ ID NO:2725, SEQ ID NO:2714, SEQ ID NO:2635, SEQ ID NO:2751, SEQ ID NO:2629, SEQ ID NO:2695, SEQ ID NO:2741, SEQ ID NO:2691, SEQ ID NO:2726, SEQ ID NO:2722, SEQ ID NO:2689, SEQ ID NO:2734, SEQ ID NO:2631, SEQ ID NO:2656, SEQ ID NO:2696, SEQ ID NO:2676, SEQ ID NO:2701, SEQ ID NO:2730, SEQ ID NO:2710, SEQ ID NO:2632, SEQ ID NO:2724, SEQ ID NO:2698, SEQ ID NO:2662, SEQ ID NO:2753, SEQ ID NO:2704, SEQ ID NO:2675, SEQ ID NO:2700, SEQ ID NO:2640, SEQ ID NO:2723, SEQ ID NO:2658, SEQ ID NO:2688, SEQ ID NO:2735, SEQ ID NO:2702, SEQ ID NO:2681, SEQ ID NO:2755, SEQ ID NO:2715, SEQ ID NO:2732, SEQ ID NO:2652, SEQ ID NO:2651, SEQ ID NO:2718, SEQ ID NO:2673, SEQ ID NO:2733, SEQ ID NO:2712, SEQ ID NO:2659, SEQ ID NO:2654, SEQ ID NO:2636, SEQ ID NO:2639, SEQ ID NO:2690, SEQ ID NO:2705, SEQ ID NO:2685, SEQ ID NO:2692, SEQ ID NO:2693, SEQ ID NO:2648, SEQ ID NO:2650, SEQ ID NO:2720, SEQ ID NO:2660, SEQ ID NO:2666, SEQ ID NO:2699, SEQ ID NO:2633, SEQ ID NO:2672, SEQ ID NO:2642, SEQ ID NO:2682, SEQ ID NO:2655, SEQ ID NO:2630, SEQ ID NO:2745, SEQ ID NO:2643, SEQ ID NO:2694, SEQ ID NO:2749, SEQ ID NO:2665, SEQ ID NO:2649, SEQ ID NO:2637, SEQ ID NO:2634, SEQ ID NO:2709, SEQ ID NO:2653, SEQ ID NO:2729 or SEQ ID NOS:333-664. The sequences may be used as diagnostic oligonucleotides for transplant rejection and/or cardiac transplant rejection. The oligonucleotide may have nucleotide sequence including DNA, cDNA, PNA, genomic DNA, or synthetic oligonucleotides.

In another aspect, the invention is directed to a method of diagnosing or monitoring transplant rejection in a patient wherein the expression level of one or more genes in a patient's bodily fluid is detected. In a further variation, the bodily fluid is peripheral blood.

In another aspect, the invention is directed to a method of diagnosing or monitoring transplant rejection in a patient, comprising detecting the expression level of four or more genes in the patient to diagnose or monitor transplant rejection in the patient wherein the four or more genes include a nucleotide sequence selected from SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, SEQ ID NO:97, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:140, SEQ ID NO:141, SEQ ID NO:142, SEQ ID NO:143, SEQ ID NO:144, SEQ ID NO:145, SEQ ID NO:146, SEQ ID NO:147, SEQ ID NO:148, SEQ ID NO:149, SEQ ID NO:150, SEQ ID NO:151, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:173, SEQ ID NO:174, SEQ ID NO:175, SEQ ID NO:176, SEQ ID NO:177, SEQ ID NO:178, SEQ ID NO:179, SEQ ID NO:180, SEQ ID NO:181, SEQ ID NO:182, SEQ ID NO:183, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, SEQ ID NO:217, SEQ ID NO:218, SEQ ID NO:219, SEQ ID NO:220, SEQ ID NO:221, SEQ ID NO:222, SEQ ID NO:223, SEQ ID NO:224, SEQ ID NO:225, SEQ ID NO:226, SEQ ID NO:227, SEQ ID NO:228, SEQ ID NO:229, SEQ ID NO:230, SEQ ID NO:231, SEQ ID NO:232, SEQ ID NO:233, SEQ ID NO:234, SEQ ID NO:235, SEQ ID NO:236, SEQ ID NO:237, SEQ ID NO:238, SEQ ID NO:239, SEQ ID NO:240, SEQ ID NO:241, SEQ ID NO:242, SEQ ID NO:243, SEQ ID NO:244, SEQ ID NO:245, SEQ ID NO:246, SEQ ID NO:247, SEQ ID NO:248, SEQ ID NO:249, SEQ ID NO:250, SEQ ID NO:251, SEQ ID NO:252, SEQ ID NO:253, SEQ ID NO:254, SEQ ID NO:255, SEQ ID NO:256, SEQ ID NO:257, SEQ ID NO:258, SEQ ID NO:259, SEQ ID NO:260, SEQ ID NO:261, SEQ ID NO:262, SEQ ID NO:263, SEQ ID NO:264, SEQ ID NO:265, SEQ ID NO:266, SEQ ID NO:267, SEQ ID NO:268, SEQ ID NO:269, SEQ ID NO:270, SEQ ID NO:271, SEQ ID NO:272, SEQ ID NO:273, SEQ ID NO:274, SEQ ID NO:275, SEQ ID NO:276, SEQ ID NO:277, SEQ ID NO:278, SEQ ID NO:279, SEQ ID NO:280, SEQ ID NO:281, SEQ ID NO:282, SEQ ID NO:283, SEQ ID NO:284, SEQ ID NO:285, SEQ ID NO:286, SEQ ID NO:287, SEQ ID NO:288, SEQ ID NO:289, SEQ ID NO:290, SEQ ID NO:291, SEQ ID NO:292, SEQ ID NO:293, SEQ ID NO:294, SEQ ID NO:295, SEQ ID NO:296, SEQ ID NO:297, SEQ ID NO:298, SEQ ID NO:299, SEQ ID NO:300, SEQ ID NO:301, SEQ ID NO:302, SEQ ID NO:303, SEQ ID NO:304, SEQ ID NO:305, SEQ ID NO:306, SEQ ID NO:307, SEQ ID NO:308, SEQ ID NO:309, SEQ ID NO:310, SEQ ID NO:311, SEQ ID NO:312, SEQ ID NO:313, SEQ ID NO:314, SEQ ID NO:315, SEQ ID NO:316, SEQ ID NO:317, SEQ ID NO:318, SEQ ID NO:319, SEQ ID NO:320, SEQ ID NO:321, SEQ ID NO:322, SEQ ID NO:323, SEQ ID NO:324, SEQ ID NO:325, SEQ ID NO:326; SEQ ID NO:327, SEQ ID NO:328, SEQ ID NO:329, SEQ ID NO:330, SEQ ID NO:331, SEQ ID NO:332, SEQ ID NO:2697, SEQ ID NO:2645, SEQ ID NO:2707, SEQ ID NO:2679, SEQ ID NO:2717, SEQ ID NO:2646, SEQ ID NO:2667, SEQ ID NO:2706, SEQ ID NO:2749, SEQ ID NO:2669, SEQ ID NO:2674, SEQ ID NO:2743, SEQ ID NO:2716, SEQ ID NO:2727, SEQ ID NO:2721, SEQ ID NO:2641, SEQ ID NO:2671, SEQ ID NO:2752, SEQ ID NO:2737, SEQ ID NO:2719, SEQ ID NO:2684, SEQ ID NO:2677, SEQ ID NO:2748, SEQ ID NO:2703, SEQ ID NO:2711, SEQ ID NO:2663, SEQ ID NO:2657, SEQ ID NO:2683, SEQ ID NO:2686, SEQ ID NO:2687, SEQ ID NO:2644, SEQ ID NO:2664, SEQ ID NO:2747, SEQ ID NO:2744, SEQ ID NO:2678, SEQ ID NO:2731, SEQ ID NO:2713, SEQ ID NO:2736, SEQ ID NO:2708, SEQ ID NO:2670, SEQ ID NO:2661, SEQ ID NO:2680, SEQ ID NO:2754, SEQ ID NO:2728, SEQ ID NO:2742, SEQ ID NO:2668, SEQ ID NO:2750, SEQ ID NO:2746, SEQ ID NO:2738, SEQ ID NO:2627, SEQ ID NO:2739, SEQ ID NO:2647, SEQ ID NO:2628, SEQ ID NO:2638, SEQ ID NO:2725, SEQ ID NO:2714, SEQ ID NO:2635, SEQ ID NO:2751, SEQ ID NO:2629, SEQ ID NO:2695, SEQ ID NO:2741, SEQ ID NO:2691, SEQ ID NO:2726, SEQ ID NO:2722, SEQ ID NO:2689, SEQ ID NO:2734, SEQ ID NO:2631, SEQ ID NO:2656, SEQ ID NO:2696, SEQ ID NO:2676, SEQ ID NO:2701, SEQ ID NO:2730, SEQ ID NO:2710, SEQ ID NO:2632, SEQ ID NO:2724, SEQ ID NO:2698, SEQ ID NO:2662, SEQ ID NO:2753, SEQ ID NO:2704, SEQ ID NO:2675, SEQ ID NO:2700, SEQ ID NO:2640, SEQ ID NO:2723, SEQ ID NO:2658, SEQ ID NO:2688, SEQ ID NO:2735, SEQ ID NO:2702, SEQ ID NO:2681, SEQ ID NO:2755, SEQ ID NO:2715, SEQ ID NO:2732, SEQ ID NO:2652, SEQ ID NO:2651, SEQ ID NO:2718, SEQ ID NO:2673, SEQ ID NO:2733, SEQ ID NO:2712, SEQ ID NO:2659, SEQ ID NO:2654, SEQ ID NO:2636, SEQ ID NO:2639, SEQ ID NO:2690, SEQ ID NO:2705, SEQ ID NO:2685, SEQ ID NO:2692, SEQ ID NO:2693, SEQ ID NO:2648, SEQ ID NO:2650, SEQ ID NO:2720, SEQ ID NO:2660, SEQ ID NO:2666, SEQ ID NO:2699, SEQ ID NO:2633, SEQ ID NO:2672, SEQ ID NO:2642, SEQ ID NO:2682, SEQ ID NO:2655, SEQ ID NO:2630, SEQ ID NO:2745, SEQ ID NO:2643, SEQ ID NO:2694, SEQ ID NO:2749, SEQ ID NO:2665, SEQ ID NO:2649, SEQ ID NO:2637, SEQ ID NO:2634, SEQ ID NO:2709, SEQ ID NO:2653, SEQ ID NO:2729.

In another aspect, the invention is directed to a method of diagnosing or monitoring kidney transplant rejection in a patient by detecting one or more proteins in a bodily fluid of the patient to diagnose or monitor transplant rejection in the patient wherein the one or more proteins have a protein sequence selected from SEQ ID NO:76, SEQ ID NO:2663, SEQ ID NO:98, SEQ ID NO:2696, SEQ ID NO:2736, SEQ ID NO:2751, SEQ ID NO:2631, SEQ ID NO:2675, SEQ ID NO:2700, and SEQ ID NO:2693.

In a further aspect, the invention is also directed to a system for detecting gene expression in body fluid including at least two isolated polynucleotides wherein the isolated polynucleotides detect expression of a gene wherein the gene includes a nucleotide sequence selected from SEQ ID NO:2, SEQ ID NO:3, SEQ ID NO:4, SEQ ID NO:5, SEQ ID NO:6, SEQ ID NO:7, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:54, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:82, SEQ ID NO:83, SEQ ID NO:84, SEQ ID NO:85, SEQ ID NO:86, SEQ ID NO:87, SEQ ID NO:88, SEQ ID NO:90, SEQ ID NO:91, SEQ ID NO:92, SEQ ID NO:93, SEQ ID NO:94, SEQ ID NO:95, SEQ ID NO:96, SEQ ID NO:98, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:173, SEQ ID NO:174, SEQ ID NO:175, SEQ ID NO:176, SEQ ID NO:177, SEQ ID NO:178, SEQ ID NO:179, SEQ ID NO:180, SEQ ID NO:181, SEQ ID NO:182, SEQ ID NO:183, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, SEQ ID NO:217, SEQ ID NO:218, SEQ ID NO:219, SEQ ID NO:220, SEQ ID NO:221, SEQ ID NO:222, SEQ ID NO:223, SEQ ID NO:224, SEQ ID NO:225, SEQ ID NO:226, SEQ ID NO:227, SEQ ID NO:228, SEQ ID NO:229, SEQ ID NO:230, SEQ ID NO:231, SEQ ID NO:232, SEQ ID NO:233, SEQ ID NO:234, SEQ ID NO:235, SEQ ID NO:236, SEQ ID NO:237, SEQ ID NO:238, SEQ ID NO:239, SEQ ID NO:240, SEQ ID NO:234, SEQ ID NO:242, SEQ ID NO:243, SEQ ID NO:244, SEQ ID NO:245, SEQ ID NO:246, SEQ ID NO:247, SEQ ID NO:248, SEQ ID NO:249, SEQ ID NO:250, SEQ ID NO:251, SEQ ID NO:252, SEQ ID NO:253, SEQ ID NO:254, SEQ ID NO:255, SEQ ID NO:256, SEQ ID NO:257, SEQ ID NO:258, SEQ ID NO:259, SEQ ID NO:260, SEQ ID NO:261, SEQ ID NO:262, SEQ ID NO:263, SEQ ID NO:264, SEQ ID NO:265, SEQ ID NO:266, SEQ ID NO:267, SEQ ID NO:268, SEQ ID NO:269, SEQ ID NO:270, SEQ ID NO:271, SEQ ID NO:272, SEQ ID NO:273, SEQ ID NO:274, SEQ ID NO:275, SEQ ID NO:276, SEQ ID NO:277, SEQ ID NO:278, SEQ ID NO:279, SEQ ID NO:280, SEQ ID NO:281, SEQ ID NO:282, SEQ ID NO:283, SEQ ID NO:284, SEQ ID NO:285, SEQ ID NO:286, SEQ ID NO:287, SEQ ID NO:288, SEQ ID NO:289, SEQ ID NO:290, SEQ ID NO:291, SEQ ID NO:292, SEQ ID NO:293, SEQ ID NO:294, SEQ ID NO:295, SEQ ID NO:296, SEQ ID NO:297, SEQ ID NO:298, SEQ ID NO:299, SEQ ID NO:300, SEQ ID NO:301, SEQ ID NO:302, SEQ ID NO:303, SEQ ID NO:304, SEQ ID NO:305, SEQ ID NO:306, SEQ ID NO:307, SEQ ID NO:308, SEQ ID NO:309, SEQ ID NO:310, SEQ ID NO:311, SEQ ID NO:312, SEQ ID NO:313, SEQ ID NO:314, SEQ ID NO:315, SEQ ID NO:316, SEQ ID NO:317, SEQ ID NO:318, SEQ ID NO:319, SEQ ID NO:320, SEQ ID NO:321, SEQ ID NO:322, SEQ ID NO:323, SEQ ID NO:324, SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:2697, SEQ ID NO:2645, SEQ ID NO:2707, SEQ ID NO:2679, SEQ ID NO:2717, SEQ ID NO:2646, SEQ ID NO:2667, SEQ ID NO:2706, SEQ ID NO:2740, SEQ ID NO:2669, SEQ ID NO:2674, SEQ ID NO:2743, SEQ ID NO:2716, SEQ ID NO:2727, SEQ ID NO:2721, SEQ ID NO:2641, SEQ ID NO:2671, SEQ ID NO:2752, SEQ ID NO:2737, SEQ ID NO:2719, SEQ ID NO:2684, SEQ ID NO:2677, SEQ ID NO:2748, SEQ ID NO:2703, SEQ ID NO:2711, SEQ ID NO:2663, SEQ ID NO:2657, SEQ ID NO:2683, SEQ ID NO:2686, SEQ ID NO:2687, SEQ ID NO:2644, SEQ ID NO:2664, SEQ ID NO:2747, SEQ ID NO:2744, SEQ ID NO:2678, SEQ ID NO:2731, SEQ ID NO:2713, SEQ ID NO:2736, SEQ ID NO:2708, SEQ ID NO:2670, SEQ ID NO:2661, SEQ ID NO:2680, SEQ ID NO:2754, SEQ ID NO:2728, SEQ ID NO:2742, SEQ ID NO:2668, SEQ ID NO:2750, SEQ ID NO:2746, SEQ ID NO:2738, SEQ ID NO:2627, SEQ ID NO:2739, SEQ ID NO:2647, SEQ ID NO:2628, SEQ ID NO:2638, SEQ ID NO:2725, SEQ ID NO:2714, SEQ ID NO:2635, SEQ ID NO:2751, SEQ ID NO:2629, SEQ ID NO:2695, SEQ ID NO:2741, SEQ ID NO:2691, SEQ ID NO:2726, SEQ ID NO:2722, SEQ ID NO:2689, SEQ ID NO:2734, SEQ ID NO:2631, SEQ ID NO:2656, SEQ ID NO:2696, SEQ ID NO:2676, SEQ ID NO:2701, SEQ ID NO:2730, SEQ ID NO:2710, SEQ ID NO:2632, SEQ ID NO:2724, SEQ ID NO:2698, SEQ ID NO:2662, SEQ ID NO:2753, SEQ ID NO:2704, SEQ ID NO:2675, SEQ ID NO:2700, SEQ ID NO:2640, SEQ ID NO:2723, SEQ ID NO:2658, SEQ ID NO:2688, SEQ ID NO:2735, SEQ ID NO:2702, SEQ ID NO:2681, SEQ ID NO:2755, SEQ ID NO:2715, SEQ ID NO:2732, SEQ ID NO:2652, SEQ ID NO:2651, SEQ ID NO:2718, SEQ ID NO:2673, SEQ ID NO:2733, SEQ ID NO:2712, SEQ ID NO:2659, SEQ ID NO:2654, SEQ ID NO:2636, SEQ ID NO:2639, SEQ ID NO:2690, SEQ ID NO:2705, SEQ ID NO:2685, SEQ ID NO:2692, SEQ ID NO:2693, SEQ ID NO:2648, SEQ ID NO:2650, SEQ ID NO:2720, SEQ ID NO:2660, SEQ ID NO:2666, SEQ ID NO:2699, SEQ ID NO:2633, SEQ ID NO:2672, SEQ ID NO:2642, SEQ ID NO:2682, SEQ ID NO:2655, SEQ ID NO:2630, SEQ ID NO:2745, SEQ ID NO:2643, SEQ ID NO:2694, SEQ ID NO:2749, SEQ ID NO:2665, SEQ ID NO:2649, SEQ ID NO:2637, SEQ ID NO:2634, SEQ ID NO:2709, SEQ ID NO:2653, SEQ ID NO:2729 and the gene is differentially expressed in body fluid in an individual rejecting a transplanted organ compared to the expression of the gene in leukocytes in an individual not rejecting a transplanted organ.

In another aspect, the invention is directed to a system for detecting gene expression in body fluid including at least two isolated polynucleotides wherein the isolated polynucleotides detect expression of a gene wherein the gene includes a nucleotide sequence selected from SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75, SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:93, SEQ ID NO:94, SEQ ID NO:95, SEQ ID NO:96, SEQ ID NO:97, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:135, SEQ ID NO:136, SEQ ID NO:137, SEQ ID NO:138, SEQ ID NO:139, SEQ ID NO:140, SEQ ID NO:141, SEQ ID NO:142, SEQ ID NO:143, SEQ ID NO:144, SEQ ID NO:145, SEQ ID NO:146, SEQ ID NO:147, SEQ ID NO:148, SEQ ID NO:149, SEQ ID NO:150, SEQ ID NO:151, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:170, SEQ ID NO:171, SEQ ID NO:172, SEQ ID NO:173, SEQ ID NO:174, SEQ ID NO:175, SEQ ID NO:176, SEQ ID NO:177, SEQ ID NO:178, SEQ ID NO:179, SEQ ID NO:180, SEQ ID NO:181, SEQ ID NO:182, SEQ ID NO:183, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, SEQ ID NO:217, SEQ ID NO:218, SEQ ID NO:219, SEQ ID NO:220, SEQ ID NO:221, SEQ ID NO:222, SEQ ID NO:223, SEQ ID NO:224, SEQ ID NO:225, SEQ ID NO:226, SEQ ID NO:227, SEQ ID NO:228, SEQ ID NO:229, SEQ ID NO:230, SEQ ID NO:231, SEQ ID NO:232, SEQ ID NO:233, SEQ ID NO:234, SEQ ID NO:235, SEQ ID NO:236, SEQ ID NO:237, SEQ ID NO:238, SEQ ID NO:239, SEQ ID NO:240, SEQ ID NO:241, SEQ ID NO:242, SEQ ID NO:243, SEQ ID NO:244, SEQ ID NO:245, SEQ ID NO:246, SEQ ID NO:247, SEQ ID NO:248, SEQ ID NO:249, SEQ ID NO:250, SEQ ID NO:251, SEQ ID NO:252, SEQ ID NO:253, SEQ ID NO:254, SEQ ID NO:255, SEQ ID NO:256, SEQ ID NO:257, SEQ ID NO:258, SEQ ID NO:259, SEQ ID NO:260, SEQ ID NO:261, SEQ ID NO:262, SEQ ID NO:263, SEQ ID NO:264, SEQ ID NO:265, SEQ ID NO:266, SEQ ID NO:267, SEQ ID NO:268, SEQ ID NO:269, SEQ ID NO:270, SEQ ID NO:271, SEQ ID NO:272, SEQ ID NO:273, SEQ ID NO:274, SEQ ID NO:275, SEQ ID NO:276, SEQ ID NO:277, SEQ ID NO:278, SEQ ID NO:279, SEQ ID NO:280, SEQ ID NO:281, SEQ ID NO:282, SEQ ID NO:283, SEQ ID NO:284, SEQ ID NO:285, SEQ ID NO:286, SEQ ID NO:287, SEQ ID NO:288, SEQ ID NO:289, SEQ ID NO:290, SEQ ID NO:291, SEQ ID NO:292, SEQ ID NO:293, SEQ ID NO:294, SEQ ID NO:295, SEQ ID NO:296, SEQ ID NO:297, SEQ ID NO:298, SEQ ID NO:299, SEQ ID NO:300, SEQ ID NO:301, SEQ ID NO:302, SEQ ID NO:303, SEQ ID NO:304, SEQ ID NO:305, SEQ ID NO:306, SEQ ID NO:307, SEQ ID NO:308, SEQ ID NO:309, SEQ ID NO:310, SEQ ID NO:311, SEQ ID NO:312, SEQ ID NO:313, SEQ ID NO:314, SEQ ID NO:315, SEQ ID NO:316, SEQ ID NO:317, SEQ ID NO:318, SEQ ID NO:319, SEQ ID NO:320, SEQ ID NO:321, SEQ ID NO:322, SEQ ID NO:323, SEQ ID NO:324, SEQ ID NO:325, SEQ ID NO:326, SEQ ID NO:327, SEQ ID NO:328, SEQ ID NO:329, SEQ ID NO:330, SEQ ID NO:331, SEQ ID NO:332, SEQ ID NO:2697, SEQ ID NO:2645, SEQ ID NO:2707, SEQ ID NO:2679, SEQ ID NO:2717, SEQ ID NO:2646, SEQ ID NO:2667, SEQ ID NO:2706, SEQ ID NO:2740, SEQ ID NO:2669, SEQ ID NO:2674, SEQ ID NO:2743, SEQ ID NO:2716, SEQ ID NO:2727, SEQ ID NO:2721, SEQ ID NO:2641, SEQ ID NO:2671, SEQ ID NO:2752, SEQ ID NO:2737, SEQ ID NO:2719, SEQ ID NO:2684, SEQ ID NO:2677, SEQ ID NO:2748, SEQ ID NO:2703, SEQ ID NO:2711, SEQ ID NO:2663, SEQ ID NO:2657, SEQ ID NO:2683, SEQ ID NO:2686, SEQ ID NO:2687, SEQ ID NO:2644, SEQ ID NO:2664, SEQ ID NO:2747, SEQ ID NO:2744, SEQ ID NO:2678, SEQ ID NO:2731, SEQ ID NO:2713, SEQ ID NO:2736, SEQ ID NO:2708, SEQ ID NO:2670, SEQ ID NO:2661, SEQ ID NO:2680, SEQ ID NO:2754, SEQ ID NO:2728, SEQ ID NO:2742, SEQ ID NO:2668, SEQ ID NO:2750, SEQ ID NO:2746, SEQ ID NO:2738, SEQ ID NO:2627, SEQ ID NO:2739, SEQ ID NO:2647, SEQ ID NO:2628, SEQ ID NO:2638, SEQ ID NO:2725, SEQ ID NO:2714, SEQ ID NO:2635, SEQ ID NO:2751, SEQ ID NO:2629, SEQ ID NO:2695, SEQ ID NO:2741, SEQ ID NO:2691, SEQ ID NO:2726, SEQ ID NO:2722, SEQ ID NO:2689, SEQ ID NO:2734, SEQ ID NO:2631, SEQ ID NO:2656, SEQ ID NO:2696, SEQ ID NO:2676, SEQ ID NO:2701, SEQ ID NO:2730, SEQ ID NO:2710, SEQ ID NO:2632, SEQ ID NO:2724, SEQ ID NO:2698, SEQ ID NO:2662, SEQ ID NO:2753, SEQ ID NO:2704, SEQ ID NO:2675, SEQ ID NO:2700, SEQ ID NO:2640, SEQ ID NO:2723, SEQ ID NO:2658, SEQ ID NO:2688, SEQ ID NO:2735, SEQ ID NO:2702, SEQ ID NO:2681, SEQ ID NO:2755, SEQ ID NO:2715, SEQ ID NO:2732, SEQ ID NO:2652, SEQ ID NO:2651, SEQ ID NO:2718, SEQ ID NO:2673, SEQ ID NO:2733, SEQ ID NO:2712, SEQ ID NO:2659, SEQ ID NO:2654, SEQ ID NO:2636, SEQ ID NO:2639, SEQ ID NO:2690, SEQ ID NO:2705, SEQ ID NO:2685, SEQ ID NO:2692, SEQ ID NO:2693, SEQ ID NO:2648, SEQ ID NO:2650, SEQ ID NO:2720, SEQ ID NO:2660, SEQ ID NO:2666, SEQ ID NO:2699, SEQ ID NO:2633, SEQ ID NO:2672, SEQ ID NO:2642, SEQ ID NO:2682, SEQ ID NO:2655, SEQ ID NO:2630, SEQ ID NO:2745, SEQ ID NO:2643, SEQ ID NO:2694, SEQ ID NO:2746, SEQ ID NO:2665, SEQ ID NO:2649, SEQ ID NO:2637, SEQ ID NO:2634, SEQ ID NO:2709, SEQ ID NO:2653, SEQ ID NO:2729 and the gene expression is related to the rate of hematopoiesis or the distribution of hematopoeitic cells along their maturation pathway.

The invention is also directed to methods of diagnosing or monitoring transplant rejection in a patient by detecting the expression level of one or more genes including a nucleotide sequence selected from SEQ ID NOS: 3016-3117. SEQ ID NOS:3108-3117 are useful in detecting CMV infection.

BRIEF DESCRIPTION OF THE SEQUENCE LISTING

SEQ ID's 1-332 are 50mer oligonucleotides corresponding to gene expression markers for diagnosis and monitoring of allograft rejection and other disorders.

SEQ ID's 333-664 are Reference mRNA sequences for genes identified by probes 1-332.

SEQ ID's 665-995 are a first set of Left PCR primers for genes 1-332.

SEQ ID's 996-1326 are a first set of Right PCR primers for genes 1-332.

SEQ ID's 1327-1657 are Taqman probes for the first set PCR primers for genes 1-332.

SEQ ID's 1658-1903 are a second alternative set of left PCR primers for selected genes 1-332

SEQ ID's 1904-2151 are a second alternative set of right PCR primers for selected genes 1-332

SEQ ID's 2152-2399 are Taqman probes for the second alternative set of PCR primers for selected genes 1-332.

SEQ ID's 2400-2626 are Proteins encoded by mRNA's from genes identified in 1-332.

SEQ ID's 2627-2795 are 50mer oligonucleotide array probes used to identify genes in FIG. 7 and Tables 6 and 8.

SEQ ID's 2796-2924 are reference mRNA sequences for genes in Table 8 which show altered expression in renal transplantation and rejection.

SEQ ID's 2925-3015 are proteins coded by genes which show altered expression in Table 8.

SEQ ID's 3016-3081 are 50mer oligonucleotide array probes and used to identify genes in the Examples.

SEQ ID's 3082-3107 are genes and primers discussed in the Examples.

SEQ ID's 3108-3117 are mRNAs from human genes in which regulation is altered upon CMV infection.

BRIEF DESCRIPTION OF THE FIGURES

FIG. 1 is a schematic flow chart illustrating a schematic instruction set for characterization of the nucleotide sequence and/or the predicted protein sequence of novel nucleotide sequences.

FIG. 2 depicts the components of an automated RNA preparation machine. A primary component of the device is a centrifuge. (A.) Tubes of whole blood containing a density gradient solution, transcription/translation inhibitors, and a gel barrier that separates erythrocytes from mononuclear cells and serum after centrifugation are placed in the centrifuge. (B.) The barrier is permeable to erythrocytes and granulocytes during centrifugation, but does not allow mononuclear cells to pass through (or the barrier substance has a density such that mononuclear cells remain above the level of the barrier during the centrifugation). After centrifugation, the erythrocytes and granulocytes are trapped beneath the barrier, facilitating isolation of the mononuclear cell and serum layers. A mechanical arm removes the tube and inverts it to mix the mononuclear cell layer and the serum. (C.) The arm next pours the supernatant into a fresh tube (D.), while the erythrocytes and granulocytes remained below the barrier. Alternatively, a needle is used to aspirate the supernatant and transfer it to a fresh tube. The mechanical arms of the device opens and closes lids, dispenses PBS to aid in the collection of the mononuclear cells by centrifugation, and moves the tubes in and out of the centrifuge. Following centrifugation, the supernatant is poured off or removed by a vacuum device (E), leaving an isolated mononuclear cell pellet. Purification of the RNA from the cells is performed automatically, with lysis buffer and other purification solutions (F.) automatically dispensed and removed before and after centrifugation steps. The result is a purified RNA solution.

FIG. 7: Cardiac Allograft rejection diagnostic genes.

A. Example of rejection and no-rejection samples expression data for 5 marker genes. For each sample, the associated rejection grades are shown as are the expression ratios for 5 differentially expressed genes. The genes are identified by the SEQ ID number for the oligonucleotide. The average fold difference between grade 0 and grade 3A samples is calculated at the bottom.

B. CART classification model. Decision tree for a 3 gene classification model for diagnosis of cardiac rejection. In the first step, expression of gene 223 is used to divide the patients to 2 branches. The remaining samples in each branch are then further divided by one remaining gene. The samples are classified as either rejection or no rejection. 1 no rejection sample is misclassified as a rejection sample.

C. Surrogates for the CART classification model. For each of the 3 splitter genes in the CART rejection model described in the example, 5 top surrogate genes are listed that were identified by the CART algorithm.

FIG. 8: Validation of differential expression of a gene discovered using microarrays using real-time PCR FIG. 8A. The Ct for each patient sample on multiple assays is shown along with the Ct in the R50 control RNA. Triangles represent -RT (reverse transcriptase) controls.

Figure 8B:
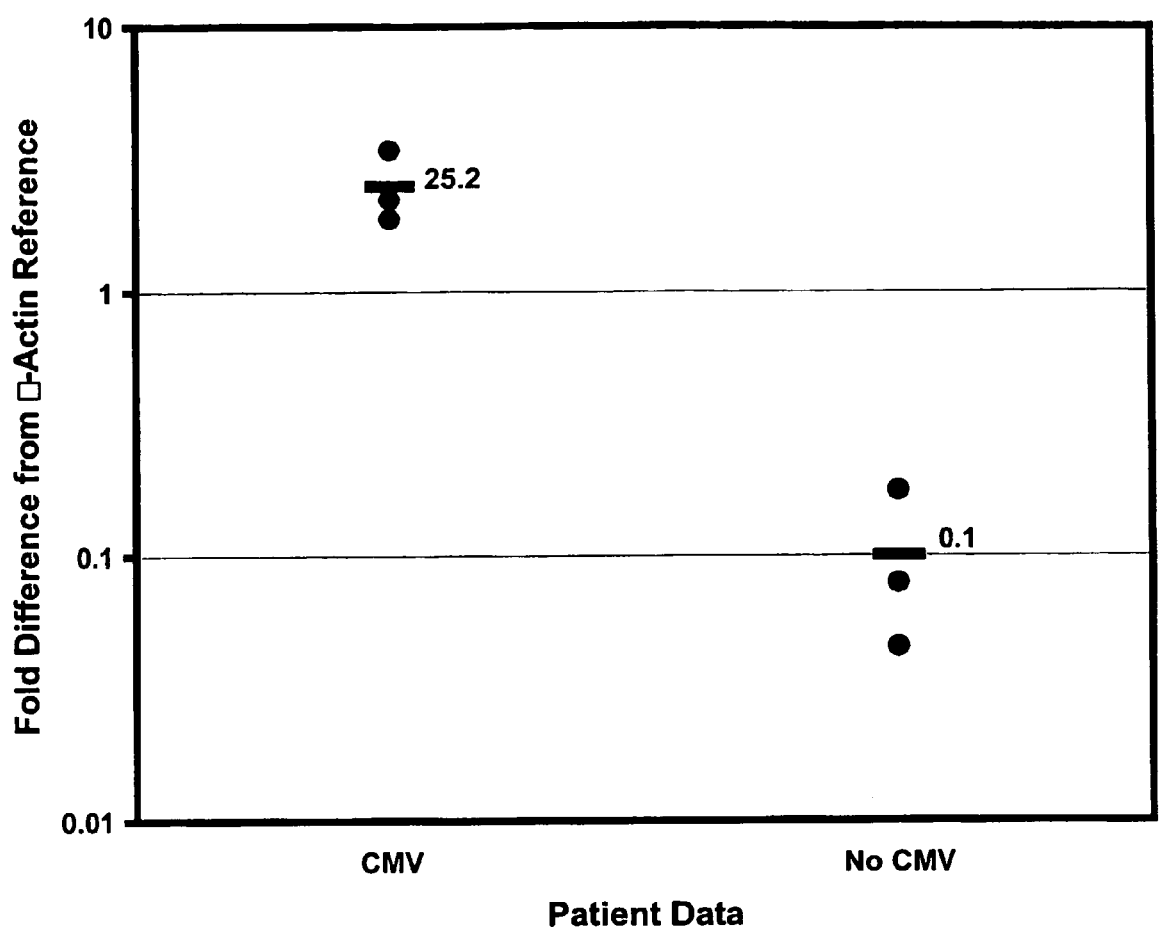

FIG. 8B. The fold difference between the expression of Granzyme B and an Actin reference is shown for 3 samples from patients with and without CMV disease.

Figure 9:
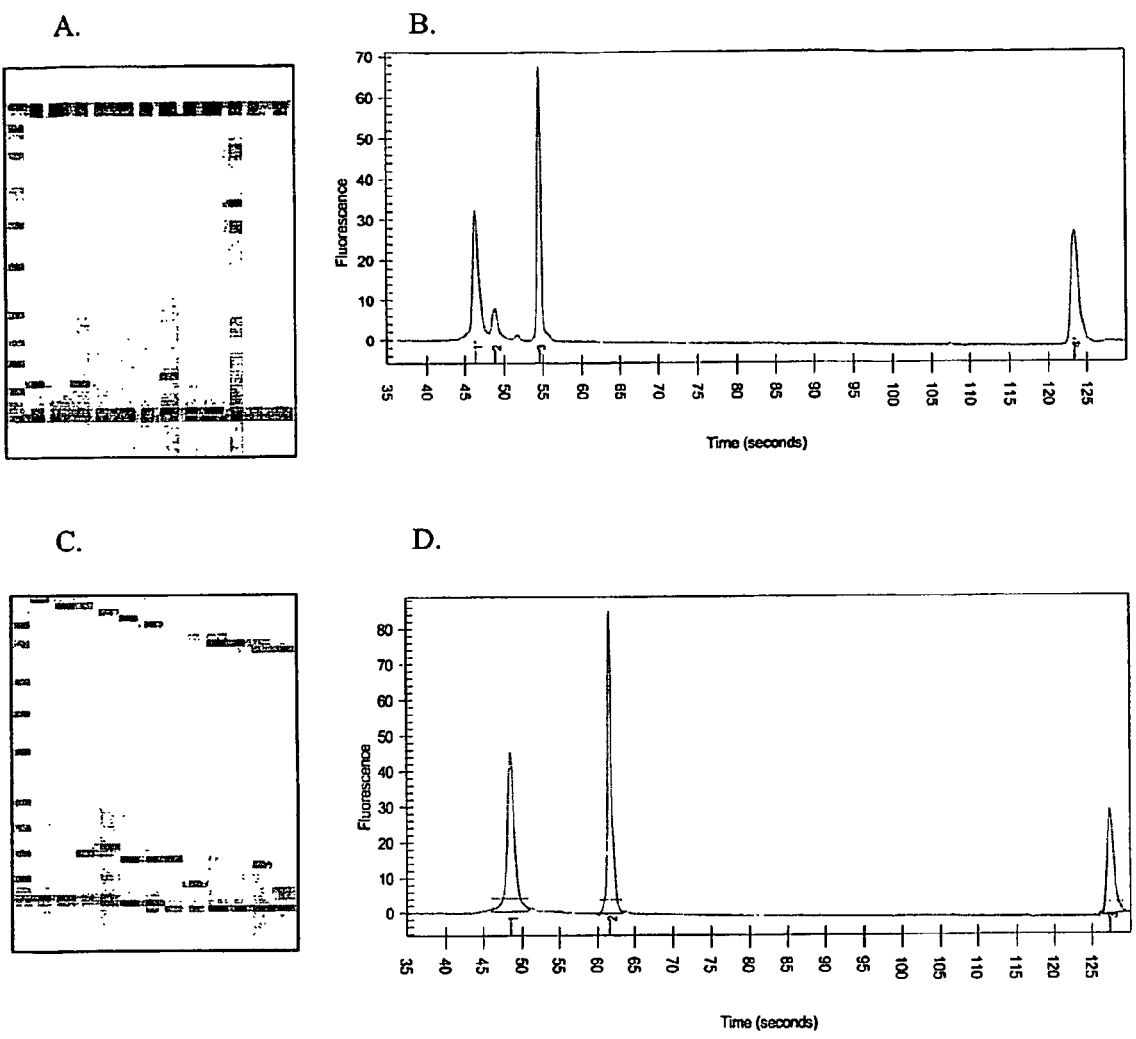

FIG. 9: Endpoint testing of PCR primers

Electrophoresis and microfluidics are used to assess the product of gene specific PCR primers. A. β-GUS gel image. Lane 3 is the image for primers F178 and R242. Lanes 2 and 1 correspond to the no-template control and -RT control, respectively.

B. The electropherogram of β-GUS primers F178 and R242, a graphical representation of Lane 3 from the gel image.

C. β-Actin gel image. Lane 3 is the image for primers F75 and R178. Lanes 2 and 1 correspond to the no-template control and -RT control, respectively.

D. The electropherogram of β-Actin primers F75 and R178, a graphical representation of Lane 3 from the gel image.

Figure 10:
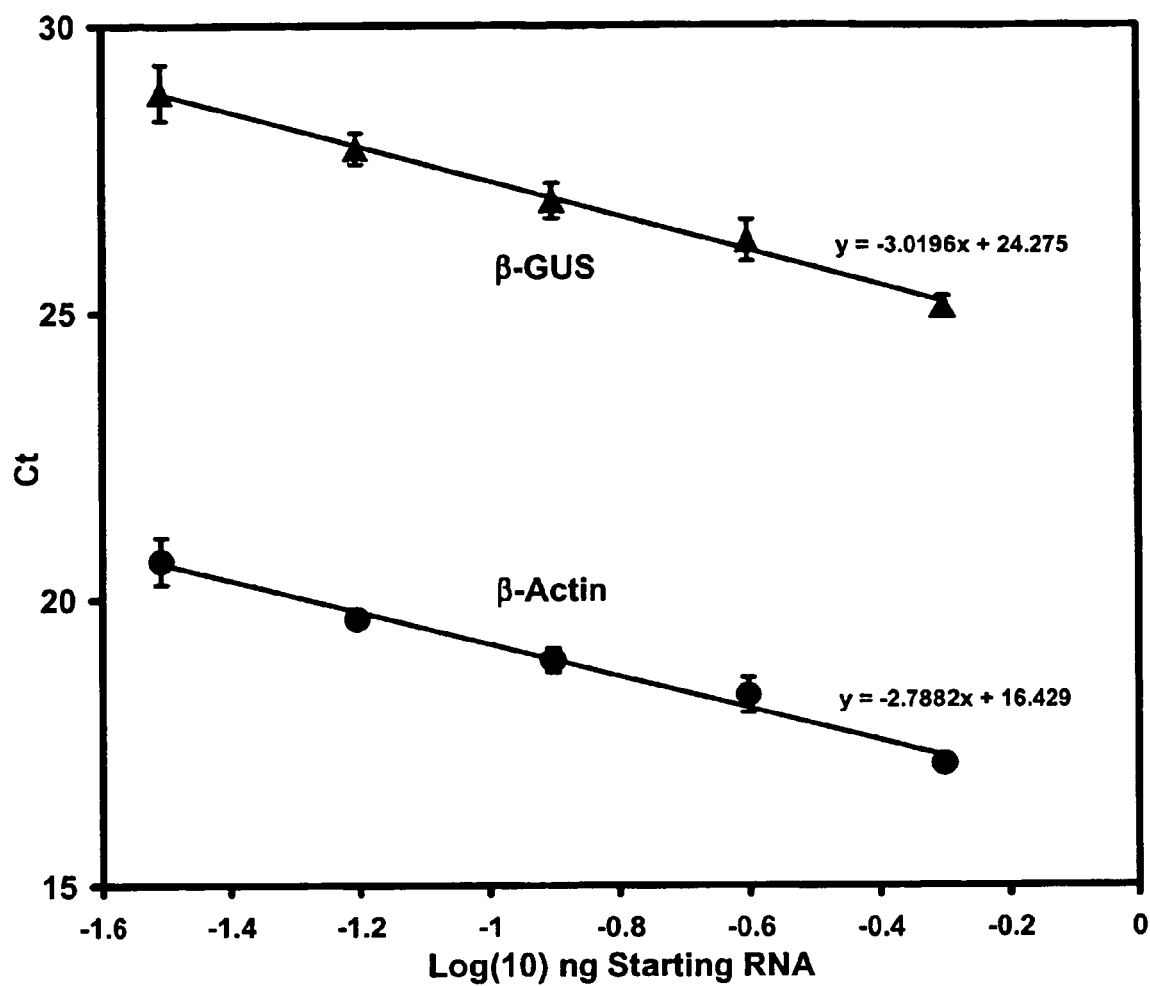

FIG. 10: PCR Primer efficiency testing. A standard curve of Ct versus log of the starting RNA amount is shown for 2 genes.

FIG. 11: Real-time PCR control gene analysis 11 candidate control genes were tested using real-time PCR on 6 whole blood samples (PAX) paired with 6 mononuclear samples (CPT) from the same patient. Each sample was tested twice. For each gene, the variability of the gene across the samples is shown on the vertical axis (A). The average $C_T$ value for each gene is also shown (B). 2 μg RNA was used for PAX samples and 0.5 μg total RNA was used for the mononuclear samples (CPT).

Figure 12:
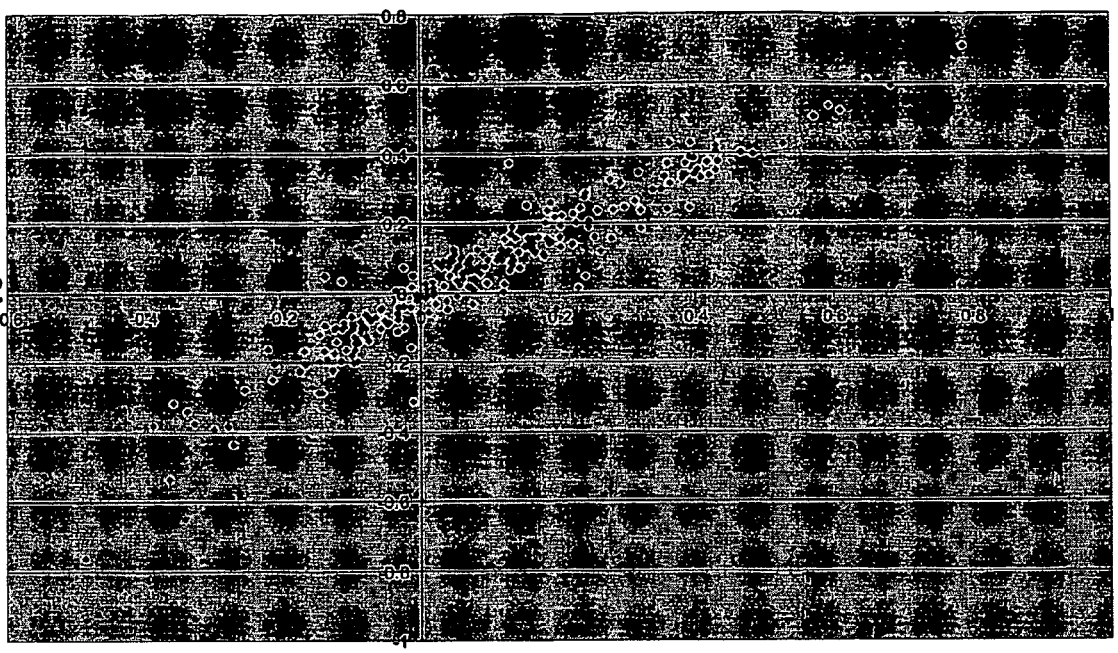

FIG. 12: Rejection marker discovery by co-expression with established marker

Microarrays were used to measure expression of genes SEQ ID 85 and 302 in samples derived from 240 transplant recipients. For each sample, the expression measurement for 85 is plotted against 302.

Figure 13:
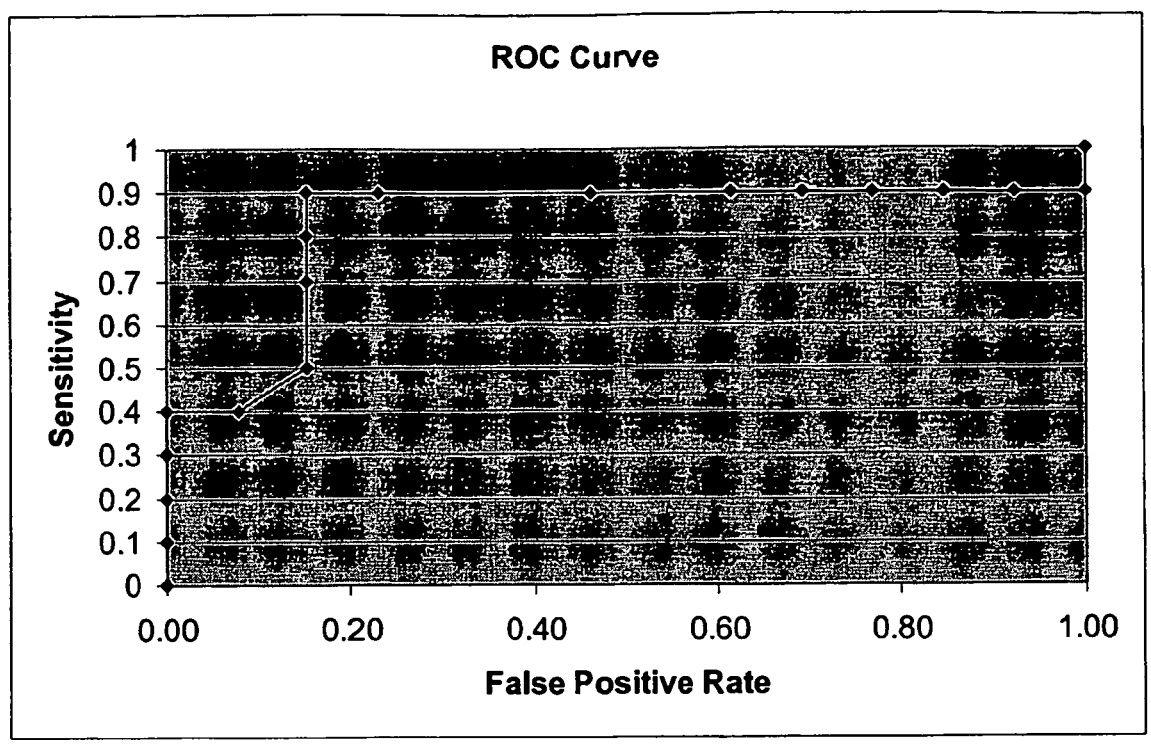

FIG. 13: ROC (receiver operator characteristics) curve for a 3-gene PCR assay for diagnosis of rejection (see example 17). The Sensitivity and False Positive Rate for each test cutoff is shown.

BRIEF DESCRIPTION OF THE TABLES

Table 1: Table 1 lists diseases or conditions amenable to study by leukocyte profiling.

Table 2: Transplant Markers

A. Transplant Genes: Genes useful for monitoring of allograft rejection are listed in this here. The gene symbol and name are given. SEQ ID 50mer is the sequence ID of a 50mer oligonucleotide that is specific for the gene. The NCBI Unigene number (HS) from (Build 160, 16 Feb. 2003) is given as is an accession number (ACC) from (Genbank Release 135, 15 Apr. 2003) for an RNA or cDNA is Genbank that corresponds to the gene. The sequence identified by the ACC number is in the sequence listing (SEQ ID RNA/cDNA).

B. Microarray Data: SEQ ID 50mer, Gene, Gene Name, ACC and SEQ ID RNA/cDNA are given for each gene as in A (above). Each identified gene has a Non-Parametric Score and Median Rank in NR given from the non-parametric analysis of the data. The genes are ranked from highest to lowest scoring. Down Regulated genes are noted with a 1 in this column.

C. PCR Primers: Primers and probes for real-time PCR assays for each gene are given along with their SEQ ID #s. Each gene has 1 or 2 sets of a forward and reverse PCR primer and a hybridization probe for detection in TaqMan or similar assays.

D. PCR Data: Real-time PCR data was generated on a set of transplant samples using sybr green technology as described in the text. For each gene the number of samples (n) used in the analysis is given. An odds ratio and the p-values for a Fisher test and t-test are given for the comparison of acute rejection samples is given (see text).

E. Transplant proteins: For each gene, the corresponding protein in the RefSeq data base (Genbank Release 135, 18 Apr. 2003) is given (RefSeq Peptide Accession #) along the SEQ ID for that protein for the sequence listing.

Table 3: Viral gene for arrays. Viral genomes were used to design oligonucleotides for the microarrays. The accession numbers for the viral genomes used are given, along with the gene name and location of the region used for oligonucleotide design.

Table 4. Dependent variables for discovery of gene expression markers of cardiac allograft rejection. A stable Grade 0 is a Grade 0 biopsy in a patient who does not experience rejection with the subsequent biopsy. HG or highest grade means that the higher of the biopsy grades from the centralized and local pathologists was used for a definition of the dependent variable.

Table 5: Real-time PCR assay reporter and quencher dyes. Various combinations of reporter and quencher dyes are useful for real-time PCR assays. Reporter and quencher dyes work optimally in specific combinations defined by their spectra. For each reporter, appropriate choices for quencher dyes are given.

Table 6: Rejection marker PCR assay results

Results of real-time PCR assays are listed for the comparison of rejection samples to no rejection samples. The fold change is given for expression of each gene in rejection/no rejection samples. The p-value for the t-test comparing the rejection and no rejection classes is given.

Table 7: Summary results of array rejection significance analysis. Summary results are given for correlation analysis of leukocyte gene expression to acute rejection using significance analysis for microarrays (SAM). Five analyses are described. The ISHLT grades used to define the rejection and no rejection classes are given. In each case the highest grade from three pathology reading was taken for analysis. All samples are used for two analyses. The other analyses reduce redundancy of patients used in the analysis by using only one sample per patient ("Non-redundant") or using only one sample per patient within a given class ("Non-redundant within class"). The number of samples used in the analysis is given and the lowest false detection rate (FDR) achieved is noted.

Table 8: Renal tissue rejection array significance analysis. Genes are listed that were identified as upregulated using microarrays on renal tissue with acute rejection versus controls. Significance analysis for microarrays (SAM) was used to determine the false detection rate for each gene (FDR). Genes with known expression in leukocytes are noted in the table.

Table 9: Rejection marker sequence analysis. For 63 of the allograft rejection markers listed in Table 2, an analysis of the gene sequence was done. The genes and proteins are identified by accession numbers. The cellular localization of each gene is described as either secreted, nuclear, mitochondrial, cytoplasmic or cellular membrane. The function of the gene is also described.

Table 10: Gene expression markers for immature cells of a variety of lineages are given in Table 10 by way of example Table 11: Changes in the rate of hematopoiesis have been correlated to a number of disease states and other pathologies. Examples of such conditions are listed in Table 11.

Table 12: This table lists the oligonucleotides and associated genes identified as having value for the diagnosis and monitoring of CMV infection. The first column gives the SEQ ID that corresponds to the oligonucleotide in the sequence listing. The unigene number, genebank accession and GI number are also given for each sequence when known. The name of the gene associated with the accession number is noted. The strand is noted as −1 or 1, meaning that the probe was designed from the complement of the sequence (−1) or directly from the sequence (1). Next, the nucleotide sequence of each probe is also given. For each gene, the false detection rate (FDR) from the significance analysis described in example 7 is given if applicable. WBC is the white blood cell count. WPT is the number of weeks past transplant.

DETAILED DESCRIPTION OF THE INVENTION

Definitions

Unless defined otherwise, all scientific and technical terms are understood to have the same meaning as commonly used in the art to which they pertain. For the purpose of the present invention, the following terms are defined below.

In the context of the invention, the term "gene expression system" refers to any system, device or means to detect gene expression and includes diagnostic agents, candidate libraries, oligonucleotide sets or probe sets.

The term "monitoring" is used herein to describe the use of gene sets to provide useful information about an individual or an individual's health or disease status. "Monitoring" can include, determination of prognosis, risk-stratification, selection of drug therapy, assessment of ongoing drug therapy, prediction of outcomes, determining response to therapy, diagnosis of a disease or disease complication, following progression of a disease or providing any information relating to a patients health status over time, selecting patients most likely to benefit from experimental therapies with known molecular mechanisms of action, selecting patients most likely to benefit from approved drugs with known molecular mechanisms where that mechanism may be important in a small subset of a disease for which the medication may not have a label, screening a patient population to help decide on a more invasive/expensive test, for example a cascade of tests from a non-invasive blood test to a more invasive option such as biopsy, or testing to assess side effects of drugs used to treat another indication.

The term "diagnostic oligonucleotide set" generally refers to a set of two or more oligonucleotides that, when evaluated for differential expression of their products, collectively yields predictive data. Such predictive data typically relates to diagnosis, prognosis, monitoring of therapeutic outcomes, and the like. In general, the components of a diagnostic oligonucleotide set are distinguished from nucleotide sequences that are evaluated by analysis of the DNA to directly determine the genotype of an individual as it correlates with a specified trait or phenotype, such as a disease, in that it is the pattern of expression of the components of the diagnostic nucleotide set, rather than mutation or polymorphism of the DNA sequence that provides predictive value. It will be understood that a particular component (or member) of a diagnostic nucleotide set can, in some cases, also present one or more mutations, or polymorphisms that are amenable to direct genotyping by any of a variety of well known analysis methods, e.g., Southern blotting, RFLP, AFLP, SSCP, SNP, and the like.

A "disease specific target oligonucleotide sequence" is a gene or other oligonucleotide that encodes a polypeptide, most typically a protein, or a subunit of a multi-subunit protein, that is a therapeutic target for a disease, or group of diseases.

A "candidate library" or a "candidate oligonucleotide library" refers to a collection of oligonucleotide sequences (or gene sequences) that by one or more criteria have an increased probability of being associated with a particular disease or group of diseases. The criteria can be, for example, a differential expression pattern in a disease state or in activated or resting leukocytes in vitro as reported in the scientific or technical literature, tissue specific expression as reported in a sequence database, differential expression in a tissue or cell type of interest, or the like. Typically, a candidate library has at least 2 members or components; more typically, the library has in excess of about 10, or about 100, or about 1000, or even more, members or components.

The term "disease criterion" is used herein to designate an indicator of a disease, such as a diagnostic factor, a prognostic factor, a factor indicated by a medical or family history, a genetic factor, or a symptom, as well as an overt or confirmed diagnosis of a disease associated with several indicators such as those selected from the above list. A disease criterion includes data describing a patient's health status, including retrospective or prospective health data, e.g. in the form of the patient's medical history, laboratory test results, diagnostic test result, clinical events, medications, lists, response(s) to treatment and risk factors, etc.

The terms "molecular signature" or "expression profile" refers to the collection of expression values for a plurality (e.g., at least 2, but frequently about 10, about 100, about 1000, or more) of members of a candidate library. In many cases, the molecular signature represents the expression pattern for all of the nucleotide sequences in a library or array of candidate or diagnostic nucleotide sequences or genes. Alternatively, the molecular signature represents the expression pattern for one or more subsets of the candidate library. The term "oligonucleotide" refers to two or more nucleotides. Nucleotides may be DNA or RNA, naturally occurring or synthetic.

The term "healthy individual," as used herein, is relative to a specified disease or disease criterion. That is, the individual does not exhibit the specified disease criterion or is not diagnosed with the specified disease. It will be understood, that the individual in question, can, of course, exhibit symptoms, or possess various indicator factors for another disease.

Similarly, an "individual diagnosed with a disease" refers to an individual diagnosed with a specified disease (or disease criterion). Such an individual may, or may not, also exhibit a disease criterion associated with, or be diagnosed with another (related or unrelated) disease.

An "array" is a spatially or logically organized collection, e.g., of oligonucleotide sequences or nucleotide sequence products such as RNA or proteins encoded by an oligonucleotide sequence. In some embodiments, an array includes antibodies or other binding reagents specific for products of a candidate library.

When referring to a pattern of expression, a "qualitative" difference in gene expression refers to a difference that is not assigned a relative value. That is, such a difference is designated by an "all or nothing" valuation. Such an all or nothing variation can be, for example, expression above or below a threshold of detection (an on/off pattern of expression). Alternatively, a qualitative difference can refer to expression of different types of expression products, e.g., different alleles (e.g., a mutant or polymorphic allele), variants (including sequence variants as well as post-translationally modified variants), etc.

In contrast, a "quantitative" difference, when referring to a pattern of gene expression, refers to a difference in expression that can be assigned a value on a graduated scale, (e.g., a 0-5 or 1-10 scale, a +–+++ scale, a grade 1-grade 5 scale, or the like; it will be understood that the numbers selected for illustration are entirely arbitrary and in no-way are meant to be interpreted to limit the invention).

Gene Expression Systems of the Invention

The invention is directed to a gene expression system having one or more DNA molecules wherein the one or more DNA molecules has a nucleotide sequence which detects expression of a gene corresponding to the oligonucleotides depicted in the Sequence Listing. In one format, the oligonucleotide detects expression of a gene that is differentially expressed in leukocytes. The gene expression system may be a candidate library, a diagnostic agent, a diagnostic oligonucleotide set or a diagnostic probe set. The DNA molecules may be genomic DNA, protein nucleic acid (PNA), cDNA or synthetic oligonucleotides. Following the procedures taught herein, one can identity sequences of interest for analyzing gene expression in leukocytes. Such sequences may be predictive of a disease state.

Diagnostic Oligonucleotides of the Invention

The invention relates to diagnostic nucleotide set(s) comprising members of the leukocyte candidate library listed in Table 2, Table 8, and in the Sequence Listing, for which a correlation exists between the health status of an individual, the individual's expression of RNA or protein products corresponding to the nucleotide sequence, and the diagnosis and prognosis of transplant rejection. In some instances, only one oligonucleotide is necessary for such detection. Members of a diagnostic oligonucleotide set may be identified by any means capable of detecting expression of RNA or protein products, including but not limited to differential expression screening, PCR, RT-PCR, SAGE analysis, high-throughput sequencing, microarrays, liquid or other arrays, protein-based methods (e.g., western blotting, proteomics, and other methods described herein), and data mining methods, as further described herein.

In one embodiment, a diagnostic oligonucleotide set comprises at least two oligonucleotide sequences listed in Table 2, Table 8, or the Sequence Listing which are differentially expressed in leukocytes in an individual with at least one disease criterion for at least one leukocyte-implicated disease relative to the expression in individual without the at least one disease criterion, wherein expression of the two or more nucleotide sequences is correlated with at least one disease criterion, as described below.

In another embodiment, a diagnostic nucleotide set comprises at least one oligonucleotide having an oligonucleotide sequence listed in Table 2, Table 8, or the Sequence Listing which is differentially expressed, and further wherein the differential expression/correlation has not previously been described. In some embodiments, the diagnostic nucleotide set is immobilized on an array.

In another embodiment, diagnostic nucleotides (or nucleotide sets) are related to the members of the leukocyte candidate library listed in Table 2, Table 8, or in the Sequence Listing, for which a correlation exists between the health status, diagnosis and prognosis of transplant rejection (or disease criterion) of an individual. The diagnostic nucleotides are partially or totally contained in (or derived from) full-length gene sequences (or predicted full-length gene sequences) for the members of the candidate library listed in Table 2, Table 8, and the sequence listing. In some cases, oligonucleotide sequences are designed from EST or Chromosomal sequences from a public database. In these cases the full-length gene sequences may not be known. Full-length sequences in these cases can be predicted using gene prediction algorithms. Alternatively the full-length can be determined by cloning and sequencing the full-length gene or genes that contain the sequence of interest using standard molecular biology approaches described here. The same is true for oligonucleotides designed from our sequencing of cDNA libraries where the cDNA does not match any sequence in the public databases.

The diagnostic nucleotides may also be derived from other genes that are coexpressed with the correlated sequence or full-length gene. Genes may share expression patterns because they are regulated in the same molecular pathway. Because of the similarity of expression behavior genes are identified as surrogates in that they can substitute for a diagnostic gene in a diagnostic gene set. Example 4 demonstrates the discovery of surrogates from the data and the sequence listing identifies and gives the sequence for surrogates for cardiac diagnostic genes.

As used herein the term "gene cluster" or "cluster" refers to a group of genes related by expression pattern. In other words, a cluster of genes is a group of genes with similar regulation across different conditions, such as graft non-rejection versus graft rejection. The expression profile for each gene in a cluster should be correlated with the expression profile of at least one other gene in that cluster. Correlation may be evaluated using a variety of statistical methods. As used herein the term "surrogate" refers to a gene with an expression profile such that it can substitute for a diagnostic gene in a diagnostic assay. Such genes are often members of the same gene cluster as the diagnostic gene. For each member of a diagnostic gene set, a set of potential surrogates can be identified through identification of genes with similar expression patterns as described below.

Many statistical analyses produce a correlation coefficient to describe the relatedness between two gene expression patterns. Patterns may be considered correlated if the correlation coefficient is greater than or equal to 0.8. In preferred embodiments, the correlation coefficient should be greater than 0.85, 0.9 or 0.95. Other statistical methods produce a measure of mutual information to describe the relatedness between two gene expression patterns. Patterns may be considered correlated if the normalized mutual information value is greater than or equal to 0.7. In preferred embodiments, the normalized mutual information value should be greater than 0.8, 0.9 or 0.95. Patterns may also be considered similar if they cluster closely upon hierarchical clustering of gene expression data (Eisen et al. 1998). Similar patterns may be those genes that are among the 1, 2, 5, 10, 20, 50 or 100 nearest neighbors in a hierarchical clustering or have a similarity score (Eisen et al. 1998) of >0.5, 0.7, 0.8, 0.9, 0.95 or 0.99. Similar patterns may also be identified as those genes found to be surrogates in a classification tree by CART (Breiman et al. 1994). Often, but not always, members of a gene cluster have similar biological functions in addition to similar gene expression patterns.

Correlated genes, clusters and surrogates are identified for the diagnostic genes of the invention. These surrogates may be used as diagnostic genes in an assay instead of, or in addition to, the diagnostic genes for which they are surrogates.

The invention also provides diagnostic probe sets. It is understood that a probe includes any reagent capable of specifically identifying a nucleotide sequence of the diagnostic nucleotide set, including but not limited to amplified DNA, amplified RNA, cDNA, synthetic oligonucleotide, partial or full-length nucleic acid sequences. In addition, the probe may identify the protein product of a diagnostic nucleotide sequence, including, for example, antibodies and other affinity reagents.

It is also understood that each probe can correspond to one gene, or multiple probes can correspond to one gene, or both, or one probe can correspond to more than one gene.

Homologs and variants of the disclosed nucleic acid molecules may be used in the present invention. Homologs and variants of these nucleic acid molecules will possess a relatively high degree of sequence identity when aligned using standard methods. The sequences encompassed by the invention have at least 40-50, 50-60, 70-80, 80-85, 85-90, 90-95 or 95-100% sequence identity to the sequences disclosed herein.

It is understood that for expression profiling, variations in the disclosed sequences will still permit detection of gene expression. The degree of sequence identity required to detect gene expression varies depending on the length of the oligomer. For a 60 mer, 6-8 random mutations or 6-8 random deletions in a 60 mer do not affect gene expression detection. Hughes, T R, et al. "Expression profiling using microarrays fabricated by an ink-jet oligonucleotide synthesizer. Nature Biotechnology, 19:343-347(2001). As the length of the DNA sequence is increased, the number of mutations or deletions permitted while still allowing gene expression detection is increased.

As will be appreciated by those skilled in the art, the sequences of the present invention may contain sequencing errors. That is, there may be incorrect nucleotides, frameshifts, unknown nucleotides, or other types of sequencing errors in any of the sequences; however, the correct sequences will fall within the homology and stringency definitions herein.

The minimum length of an oligonucleotide probe necessary for specific hybridization in the human genome can be estimated using two approaches. The first method uses a statistical argument that the probe will be unique in the human genome by chance. Briefly, the number of independent perfect matches (Po) expected for an oligonucleotide of length L in a genome of complexity C can be calculated from the equation (Laird C D, Chromosoma 32:378 (1971):

$$Po=(\frac{1}{4})^{L}*2C$$

In the case of mammalian genomes, $2C=\sim3.6\times10^9$, and an oligonucleotide of 14-15 nucleotides is expected to be represented only once in the genome. However, the distribution of nucleotides in the coding sequence of mammalian genomes is nonrandom (Lathe, R. J. Mol. Biol. 183:1 (1985) and longer oligonucleotides may be preferred in order to in increase the specificity of hybridization. In practical terms, this works out to probes that are 19-40 nucleotides long (Sambrook J et al., infra). The second method for estimating the length of a specific probe is to use a probe long enough to hybridize under the chosen conditions and use a computer to search for that sequence or close matches to the sequence in the human genome and choose a unique match. Probe sequences are chosen based on the desired hybridization properties as described in Chapter 11 of Sambrook et al, infra. The PRIMER3 program is useful for designing these probes (S. Rozen and H. Skaletsky 1996, 1997; Primer3 code available at the web site located at genome.wi.mit.edu/genome_software/other/primer3.html). The sequences of these probes are then compared pair wise against a database of the human genome sequences using a program such as BLAST or MEGABLAST (Madden, T. L et al. (1996) Meth. Enzymol. 266:131-141). Since most of the human genome is now contained in the database, the number of matches will be determined. Probe sequences are chosen that are unique to the desired target sequence.

In some embodiments, a diagnostic probe set is immobilized on an array. The array is optionally comprises one or more of: a chip array, a plate array, a bead array, a pin array, a membrane array, a solid surface array, a liquid array, an oligonucleotide array, a polynucleotide array or a cDNA array, a microtiter plate, a pin array, a bead array, a membrane or a chip.

In some embodiments, the leukocyte-implicated disease is selected from the diseases listed in Table 1. In other embodiments, In some embodiments, the disease is atherosclerosis or cardiac allograft rejection. In other embodiments, the disease is congestive heart failure, angina, and myocardial infarction.

In some embodiments, diagnostic nucleotides of the invention are used as a diagnostic gene set in combination with genes that are know to be associated with a disease state ("known markers"). The use of the diagnostic nucleotides in combination with the known markers can provide information that is not obtainable through the known markers alone. The known markers include those identified by the prior art listing provided.

Hematopoeisis

The present invention is also directed to methods of measurement of the rate of hematopoiesis using the diagnostic oligonucleotides of the invention and measurement of the rates of hematopoeisis by any technique as a method for the monitoring and diagnosis of transplant rejection. Precursor and immature cells often have cell specific phenotypic markers. These are genes and/or proteins that expressed in a restricted manner in immature or precursor cells. This expression decreases with maturation. Gene expression markers for immature cells of a variety of lineages are given in Table 10 below by way of example.

TABLE 10

| Gene | Cell type |
|---|---|
| CD10 | B-lymphoblasts |
| RAG1 | B-lymphoblasts |
| RAG2 | B-lymphoblasts |
| NF-E2 | Platelets/Megakaryocyte/Erythroid |
| GATA-1 | Platelets/Megakaryocyte |
| GP IIb | Platelets |
| pf4 | Platelets |
| EPO-R | Erythroblast |
| Band 4.1 | Erythrocyte |
| ALAS2 | Erythroid specific heme biosynthesis |
| hemoglobin chains | Erythocyte |
| 2,3-BPG mutase | Erythrocyte |
| CD16b | Neutrophil |
| LAP | Neutrophil |
| CD16 | NK cells |
| CD159a | NK cells |

By measuring the levels of these and other genes in peripheral blood samples, an assessment of the number and proportion of immature or precursor cells can be made. Of particular use is RNA quantification in erythrocytes and platelets. These cells are anucleated in their mature forms. During development, platelets pinch off of a megakaryocyte and take a compliment of RNA without a nucleus. This RNA is quickly consumed by the platelet. Erythrocytes start as nucleated cells, but the nucleus extrudes toward the end of the maturation process. These cells have RNA which is rapidly consumed within the first 2 days of the cells 120 day life span.

For these anucleated cell types, gene expression markers must be specific only to the cell line (and not the immature form) to be useful as measures of cellular production rates. Genes specific to the lineage vs. other blood cell types will serve as markers of cellular production rates when measured on the RNA level. This is because RNA is specific to immature forms in these cases. For example, hemoglobin is specific to erythrocytes, but hemoglobin RNA is specific to newly produced erythrocytes. Therefore, if the rate of production of erythrocytes increases, so will the level of a lineage specific RNA (e.g., hemoglobin).

Hematopoietic growth factors and cytokines have incomplete lineage specificity. G-CSF is administered to patient with low granulocyte counts and the effect is a stimulation of all lineages (granulocytes, erythrocytes, platelets, etc. . . . ). Hemolytic anemia leads to increased production of multiple cell lineages although the only lineage in increased demand is the erythrocyte. Because of this lack of specificity of hematopoietic responses, erythrocyte and platelet production rates may serve as surrogates of increased production of lymphocyte lineages. Using RBCs and platelets production rates as surrogates for lymphocyte lineages may be useful because of the lack of a nucleus in these cells and the ease of measuring cellular production rates by simply measuring lineage specific RNA levels.

Hematopoiesis rates can be measured using gene expression profiling of peripheral blood. RBC and platelet specific genes provide unique opportunity for this because of their lack of a nucleus and kinetics. New cells=new/much more RNA from these cell types in peripheral blood. Immature lymphocytes may be even more specific for immune activation and rejection. Cell specific markers of lymphocyte precursors were identified (aka lymphoblasts) see below. Granulocyte precursors and markers of megakaryocytes or premature forms of any blood cells may be useful in this regard.

Applications for Measuring the Rate of Hematopoiesis

Changes in the rate of hematopoiesis have been correlated to a number of disease states and other pathologies. Examples of such conditions are listed in Table 11. One of skill in the art would be aware of other such conditions. In addition, one aspect of the present invention is the identification of the linkage between changes in the rate of hematopoiesis. The methods of the present invention directed to measuring the rates of hematopoiesis can therefore be applied to the diagnosis and monitoring of a number of disease states and other pathologies. In addition, these methods can be beneficial in determining appropriate therapies for patients.

TABLE 11

| Disorder/condition | Cell type | Cell production | Therapy |
|---|---|---|---|
| Anemia - Iron Deficiency | Erythrocyte | Decreased | Iron |
| Anemia - B12, Folate deficiency | Erythrocyte | Decreased | B12, Folate |
| Anemia - Aplastic | Erythrocyte | Decreased | Epogen, transfusion |
| Anemia - hemolytic | Erythrocyte | Increased | Immunosuppression, Splenectomy |
| Anemia - Renal failure | Erythrocyte | Decreased | Erythropoietin |
| Anemia - Chronic disease | Erythrocyte | Decreased | Treat underlying cause |
| Polycythemia rubra vera | Erythrocyte | Increased | |
| Idiophic Thrrombocytopenic purpura | Platelet | Increased | Immunosuppression, Splenectomy |
| Thrombotic Thrombocytopenic purpura | Platelet | Increased or decreased | Immunosuppression, plasmapheresis |
| Essential thrombocytosis | Platelet | Increased | |
| Leukemia | All lineages, variable | Increase, decreased or abnormal | Chemotherapy, BMT |
| Cytopenias due to immunosupression | All lineages, variable | Decreased | Epo, neupogen |
| Cytopenias due to Chemotherapy | All lineages, variable | Decreased | Epo, GCSF, GMCSF |
| GVHD | All lineages, variable | Decreased | Immunosuppression |
| Myelodysplasia | All lineages, variable | Decreased, increased or abnormal | Chemo? |
| Allograft rejection | Lymphocytes, All lineages | Increased | Immunosuppression |
| Autoimmune diseases (many) | Lymphocytes, All lineages | Increased | Immunosuppression |

The methods of the present invention are also useful for monitoring treatment regimens of diseases or other pathologies which are correlated with changes in the rate of hematopoiesis. Furthermore, the methods may be used to monitor treatment with agents that affect the rate of hematopoiesis. One of skill in the art is aware of many such agents. The following agents are examples of such.

Erythropoietin is a growth factor that is used to treat a variety of anemias that are due to decreased red cell production. Monitoring of red cell production by gene expression or other means may improve dosing and provide a means for earlier assessment of response to therapy for this expensive drug.

Neupogen (G-CSF) is used for the treatment of low neutrophil counts (neutropenia) usually related to immunosuppression or chemotherapy. Monitoring neutrophil production by gene expression testing or another means may improve dosing, patient selection, and shorten duration of therapy.

Prednisone/Immunosuppression—One of most common side effects of immunosuppression is suppression of hematopoiesis. This may occur in any cell lineage. Gene expression monitoring or other measures of hematopoietic rates could be used to monitor regularly for cytopenias in a particular cell line and the information could be used to modify dosing, modify therapy or add a specific hematologic growth factor. Following cell counts themselves is less sensitive and results in the need for prolonged trials of therapies at a given dose before efficacy and toxicity can be assessed.

Monitoring of chemotherapeutic agents—Most chemotherapy agents suppress the bone marrow for some or all lineages. Gene expression testing or other means of assessing hematopoietic rates could be used to monitor regularly for cytopenias in a particular cell line and use information to modify dosing, modify therapy or add a specific hematologic growth factor.

General Molecular Biology References

In the context of the invention, nucleic acids and/or proteins are manipulated according to well known molecular biology techniques. Detailed protocols for numerous such procedures are described in, e.g., in Ausubel et al. *Current Protocols in Molecular Biology* (supplemented through 2000) John Wiley & Sons, New York ("Ausubel"); Sambrook et al. *Molecular Cloning—A Laboratory Manual* (2nd Ed.), Vol. 1-3, Cold Spring Harbor Laboratory, Cold Spring Harbor, N.Y., 1989 ("Sambrook"), and Berger and Kimmel *Guide to Molecular Cloning Techniques, Methods in Enzymology* volume 152 Academic Press, Inc., San Diego, Calif. ("Berger").

In addition to the above references, protocols for in vitro amplification techniques, such as the polymerase chain reaction (PCR), the ligase chain reaction (LCR), Q-replicase amplification, and other RNA polymerase mediated techniques (e.g., NASBA), useful e.g., for amplifying cDNA probes of the invention, are found in Mullis et al. (1987) U.S. Pat. No. 4,683,202; *PCR Protocols A Guide to Methods and Applications* (Innis et al. eds) Academic Press Inc. San Diego, Calif. (1990) ("Innis"); Arnheim and Levinson (1990) *C&EN* 36; *The Journal Of NIH Research* (1991) 3:81; Kwoh et al. (1989) *Proc Natl Acad Sci USA* 86, 1173; Guatelli et al. (1990) *Proc Natl Acad Sci USA* 87:1874; Lomell et al. (1989) *J Clin Chem* 35:1826; Landegren et al. (1988) *Science* 241: 1077; Van Brunt (1990) *Biotechnology* 8:291; Wu and Wallace (1989) *Gene* 4: 560; Barringer et al. (1990) *Gene* 89:117, and Sooknanan and Malek (1995) *Biotechnology* 13:563. Additional methods, useful for cloning nucleic acids in the context of the present invention, include Wallace et al. U.S. Pat. No. 5,426,039. Improved methods of amplifying large nucleic acids by PCR are summarized in Cheng et al. (1994) *Nature* 369:684 and the references therein.

Certain polynucleotides of the invention, e.g., oligonucleotides can be synthesized utilizing various solid-phase strategies involving mononucleotide- and/or trinucleotide-based phosphoramidite coupling chemistry. For example, nucleic acid sequences can be synthesized by the sequential addition of activated monomers and/or trimers to an elongating polynucleotide chain. See e.g., Caruthers, M. H. et al. (1992) *Meth Enzymol* 211:3.

In lieu of synthesizing the desired sequences, essentially any nucleic acid can be custom ordered from any of a variety of commercial sources, such as The Midland Certified Reagent Company, The Great American Gene Company ExpressGen, Inc., Operon Technologies, Inc. and many others.

Similarly, commercial sources for nucleic acid and protein microarrays are available, and include, e.g., Agilent Technologies, Palo Alto, Calif. Affymetrix, Santa Clara, Calif.; and others.

One area of relevance to the present invention is hybridization of oligonucleotides. Those of skill in the art differentiate hybridization conditions based upon the stringency of hybridization. For example, highly stringent conditions could include hybridization to filter-bound DNA in 0.5 M $NaHPO_4$, 7% sodium dodecyl sulfate (SDS), 1 mM EDTA at 65° C., and washing in 0.1×SSC/0.1% SDS at 68° C. (Ausubel F. M. et al., eds., 1989, Current Protocols in Molecular Biology, Vol. I, Green Publishing Associates, Inc., and John Wiley & sons, Inc., New York, at p. 2.10.3). Moderate stringency conditions could include, e.g., washing in 0.2×SSC/0.1% SDS at 42° C. (Ausubel et al., 1989, supra).

The invention also includes nucleic acid molecules, preferably DNA molecules, that hybridize to, and are therefore the complements of, the DNA sequences of the present invention. Such hybridization conditions may be highly stringent or less highly stringent, as described above. In instances wherein the nucleic acid molecules are deoxyoligonucleotides ("oligos"), highly stringent conditions may refer, e.g., to washing in 6×SSC/0.05% sodium pyrophosphate at 37° C. (for 14-base oligos), 48° C. (for 17-base oligos), 55° C. (for 20-base oligos), and 60° C. (for 23-base oligos). These nucleic acid molecules may act as target nucleotide sequence antisense molecules, useful, for example, in target nucleotide sequence regulation and/or as antisense primers in amplification reactions of target nucleotide sequence nucleic acid sequences. Further, such sequences may be used as part of ribozyme and/or triple helix sequences, also useful for target nucleotide sequence regulation. Still further, such molecules may be used as components of diagnostic methods whereby the presence of a disease-causing allele, may be detected.

Identification of Diagnostic Nucleotide Sets

Candidate Library

Libraries of candidates that are differentially expressed in leukocytes are substrates for the identification and evaluation of diagnostic oligonucleotide sets and disease specific target nucleotide sequences.

The term leukocyte is used generically to refer to any nucleated blood cell that is not a nucleated erythrocyte. More specifically, leukocytes can be subdivided into two broad classes. The first class includes granulocytes, including, most prevalently, neutrophils, as well as eosinophils and basophils at low frequency. The second class, the non-granular or mononuclear leukocytes, includes monocytes and lymphocytes (e.g., T cells and B cells). There is an extensive literature in the art implicating leukocytes, e.g., neutrophils, monocytes and lymphocytes in a wide variety of disease processes, including inflammatory and rheumatic diseases, neurodegenerative diseases (such as Alzheimer's dementia), cardiovascular disease, endocrine diseases, transplant rejection, malignancy and infectious diseases, and other diseases listed in Table 1. Mononuclear cells are involved in the chronic immune response, while granulocytes, which make up approximately 60% of the leukocytes, have a non-specific and stereotyped response to acute inflammatory stimuli and often have a life span of only 24 hours.

In addition to their widespread involvement and/or implication in numerous disease related processes, leukocytes are particularly attractive substrates for clinical and experimental evaluation for a variety of reasons. Most importantly, they are readily accessible at low cost from essentially every potential subject. Collection is minimally invasive and associated with little pain, disability or recovery time. Collection can be performed by minimally trained personnel (e.g., phlebotomists, medical technicians, etc.) in a variety of clinical and non-clinical settings without significant technological expenditure. Additionally, leukocytes are renewable, and thus available at multiple time points for a single subject.

Assembly of an Initial Candidate Library

The initial candidate library was assembled from a combination of "mining" publication and sequence databases and construction of a differential expression library. Candidate oligonucleotide sequences in the library may be represented by a full-length or partial nucleic acid sequence, deoxyribonucleic acid (DNA) sequence, cDNA sequence, RNA sequence, synthetic oligonucleotides, etc. The nucleic acid sequence can be at least 19 nucleotides in length, at least 25 nucleotides, at least 40 nucleotides, at least 100 nucleotides, or larger. Alternatively, the protein product of a candidate nucleotide sequence may be represented in a candidate library using standard methods, as further described below. In selecting and validatating diagnostic oligonucleotides, an initial library of 8,031 candidate oligonucleotide sequences using nucleic acid sequences of 50 nucleotides in length was constructed as described below.

Candidate Nucleotide Library of the Invention

We identified members of an initial candidate nucleotide library that are differentially expressed in activated leukocytes and resting leukocytes. From that initial candidate nucleotide library, a pool of candidates was selected as listed in Table 2, Table 8, and the sequence listing. Accordingly, the invention provides the candidate leukocyte nucleotide library comprising the nucleotide sequences listed in Table 2, Table 8, and in the sequence listing. In another embodiment, the invention provides an candidate library comprising at least one nucleotide sequence listed in Tables 2 and 8 and the sequence listing. In another embodiment, the invention provides an candidate library comprising at least two nucleotide sequences listed in Tables 2 and 8 and the sequence listing. In another embodiment, the at least two nucleotide sequence are at least 19 nucleotides in length, at least 35 nucleotides, at least 40 nucleotides or at least 100 nucleotides. In some embodiments, the nucleotide sequences comprises deoxyribonucleic acid (DNA) sequence, ribonucleic acid (RNA) sequence, synthetic oligonucleotide sequence, or genomic DNA sequence. It is understood that the nucleotide sequences may each correspond to one gene, or that several nucleotide sequences may correspond to one gene, or both.

The invention also provides probes to the candidate nucleotide library. In one embodiment of the invention, the probes comprise at least two nucleotide sequences listed in Table 2, Table 8, or the sequence listing which are differentially expressed in leukocytes in an individual with a least one disease criterion for at least one leukocyte-related disease and in leukocytes in an individual without the at least one disease criterion, wherein expression of the two or more nucleotide sequences is correlated with at least one disease criterion. It is understood that a probe may detect either the RNA expression or protein product expression of the candidate nucleotide library. Alternatively, or in addition, a probe can detect a genotype associated with a candidate nucleotide sequence, as further described below. In another embodiment, the probes for the candidate nucleotide library are immobilized on an array.

The candidate nucleotide library of the invention is useful in identifying diagnostic nucleotide sets of the invention and is itself a diagnostic nucleotide set of the invention, as described below. The candidate nucleotide sequences may be further characterized, and may be identified as a disease target nucleotide sequence and/or a novel nucleotide sequence, as described below. The candidate nucleotide sequences may also be suitable for use as imaging reagents, as described below.

Detection of Non-Leukocyte Expressed Genes

When measuring gene expression levels in a blood sample, RNAs may be measured that are not derived from leukocytes. Examples are viral genes, free RNAs that have been released from damaged non-leukocyte cell types or RNA from circulating non-leukocyte cell types. For example, in the process of acute allograft rejection, tissue damage may result in release of allograft cells or RNAs derived from allograft cells into the circulation. In the case of cardiac allografts, such transcripts may be specific to muscle (myoglobin) or to cardiac muscle (Troponin I, Toponin T, CK-MB). Presence of cardiac specific mRNAs in peripheral blood may indicate ongoing or recent cardiac cellular damage (resulting from acute rejection). Therefore, such genes may be excellent diagnostic markers for allograft rejection.

Generation of Expression Patterns

RNA, DNA or Protein Sample Procurement

Following identification or assembly of a library of differentially expressed candidate nucleotide sequences, leukocyte expression profiles corresponding to multiple members of the candidate library are obtained. Leukocyte samples from one or more subjects are obtained by standard methods. Most typically, these methods involve trans-cutaneous venous sampling of peripheral blood. While sampling of circulating leukocytes from whole blood from the peripheral vasculature is generally the simplest, least invasive, and lowest cost alternative, it will be appreciated that numerous alternative sampling procedures exist, and are favorably employed in some circumstances. No pertinent distinction exists, in fact, between leukocytes sampled from the peripheral vasculature, and those obtained, e.g., from a central line, from a central artery, or indeed from a cardiac catheter, or during a surgical procedure which accesses the central vasculature. In addition, other body fluids and tissues that are, at least in part, composed of leukocytes are also desirable leukocyte samples. For example, fluid samples obtained from the lung during bronchoscopy may be rich in leukocytes, and amenable to expression profiling in the context of the invention, e.g., for the diagnosis, prognosis, or monitoring of lung transplant rejection, inflammatory lung diseases or infectious lung disease. Fluid samples from other tissues, e.g., obtained by endoscopy of the colon, sinuses, esophagus, stomach, small bowel, pancreatic duct, biliary tree, bladder, ureter, vagina, cervix or uterus, etc., are also suitable. Samples may also be obtained other sources containing leukocytes, e.g., from urine, bile, cerebrospinal fluid, feces, gastric or intestinal secretions, semen, or solid organ or joint biopsies.

Most frequently, mixed populations of leukocytes, such as are found in whole blood are utilized in the methods of the present invention. A crude separation, e.g., of mixed leukocytes from red blood cells, and/or concentration, e.g., over a sucrose, percoll or ficoll gradient, or by other methods known in the art, can be employed to facilitate the recovery of RNA or protein expression products at sufficient concentrations, and to reduce non-specific background. In some instances, it can be desirable to purify sub-populations of leukocytes, and methods for doing so, such as density or affinity gradients, flow cytometry, fluorescence Activated Cell Sorting (FACS), immuno-magnetic separation, "panning," and the like, are described in the available literature and below.

Obtaining DNA, RNA and Protein Samples for Expression Profiling

Expression patterns can be evaluated at the level of DNA, or RNA or protein products. For example, a variety of techniques are available for the isolation of RNA from whole blood. Any technique that allows isolation of mRNA from cells (in the presence or absence of rRNA and tRNA) can be utilized. In brief, one method that allows reliable isolation of total RNA suitable for subsequent gene expression analysis, is described as follows. Peripheral blood (either venous or arterial) is drawn from a subject, into one or more sterile, endotoxin free, tubes containing an anticoagulant (e.g., EDTA, citrate, heparin, etc.). Typically, the sample is divided into at least two portions. One portion, e.g., of 5-8 ml of whole blood is frozen and stored for future analysis, e.g., of DNA or protein. A second portion, e.g., of approximately 8 ml whole blood is processed for isolation of total RNA by any of a variety of techniques as described in, e.g., Sambook, Ausubel, below, as well as U.S. Pat. Nos. 5,728,822 and 4,843,155.

Typically, a subject sample of mononuclear leukocytes obtained from about 8 ml of whole blood, a quantity readily available from an adult human subject under most circumstances, yields 5-20 µg of total RNA. This amount is ample, e.g., for labeling and hybridization to at least two probe arrays. Labeled probes for analysis of expression patterns of nucleotides of the candidate libraries are prepared from the subject's sample of RNA using standard methods. In many cases, cDNA is synthesized from total RNA using a polyT primer and labeled, e.g., radioactive or fluorescent, nucleotides. The resulting labeled cDNA is then hybridized to probes corresponding to members of the candidate nucleotide library, and expression data is obtained for each nucleotide sequence in the library. RNA isolated from subject samples (e.g., peripheral blood leukocytes, or leukocytes obtained from other biological fluids and samples) is next used for analysis of expression patterns of nucleotides of the candidate libraries.

In some cases, however, the amount of RNA that is extracted from the leukocyte sample is limiting, and amplification of the RNA is desirable. Amplification may be accomplished by increasing the efficiency of probe labeling, or by amplifying the RNA sample prior to labeling. It is appreciated that care must be taken to select an amplification procedure that does not introduce any bias (with respect to gene expression levels) during the amplification process.

Several methods are available that increase the signal from limiting amounts of RNA, e.g. use of the Clontech (Glass Fluorescent Labeling Kit) or Stratagene (Fairplay Microarray Labeling Kit), or the Micromax kit (New England Nuclear, Inc.). Alternatively, cDNA is synthesized from RNA using a T7-polyT primer, in the absence of label, and DNA dendrimers from Genisphere (3DNA Submicro) are hybridized to the poly T sequence on the primer, or to a different "capture sequence" which is complementary to a fluorescently labeled sequence. Each 3DNA molecule has 250 fluorescent molecules and therefore can strongly label each cDNA.

Alternatively, the RNA sample is amplified prior to labeling For example, linear amplification may be performed, as described in U.S. Pat. No. 6,132,997. A T7-polyT primer is used to generate the cDNA copy of the RNA. A second DNA strand is then made to complete the substrate for amplification. The T7 promoter incorporated into the primer is used by a T7 polymerase to produce numerous antisense copies of the original RNA. Fluorescent dye labeled nucleotides are directly incorporated into the RNA. Alternatively, amino allyl labeled nucleotides are incorporated into the RNA, and then fluorescent dyes are chemically coupled to the amino allyl groups, as described in Hughes. Other exemplary methods for amplification are described below.

It is appreciated that the RNA isolated must contain RNA derived from leukocytes, but may also contain RNA from other cell types to a variable degree. Additionally, the isolated RNA may come from subsets of leukocytes, e.g. monocytes and/or T-lymphocytes, as described above. Such consideration of cell type used for the derivation of RNA depend on the method of expression profiling used. Subsets of leukocytes can be obtained by fluorescence activated cell sorting (FACS), microfluidics cell separation systems or a variety of other methods. Cell sorting may be necessary for the discovery of diagnostic gene sets, for the implementation of gene sets as products or both. Cell sorting can be achieved with a variety of technologies (See Galbraith et al. 1999, Cantor et al. 1975, see also the technology of Guava Technologies, Hayward, Calif.).

DNA samples may be obtained for analysis of the presence of DNA mutations, single nucleotide polymorphisms (SNPs), or other polymorphisms. DNA is isolated using standard techniques, e.g. *Maniatus*, supra.

Expression of products of candidate nucleotides may also be assessed using proteomics. Protein(s) are detected in samples of patient serum or from leukocyte cellular protein. Serum is prepared by centrifugation of whole blood, using standard methods. Proteins present in the serum may have been produced from any of a variety of leukocytes and non-leukocyte cells, and include secreted proteins from leukocytes. Alternatively, leukocytes or a desired sub-population of leukocytes are prepared as described above. Cellular protein is prepared from leukocyte samples using methods well known in the art, e.g., Trizol (Invitrogen Life Technologies, cat # 15596108; Chomczynski, P. and Sacchi, N. (1987) Anal. Biochem. 162, 156; Simms, D., Cizdziel, P. E., and Chomczynski, P. (1993) Focus® 15, 99; Chomczynski, P., Bowers-Finn, R., and Sabatini, L. (1987) J. of NIH Res. 6, 83; Chomczynski, P. (1993) Bio/Techniques 15, 532; Bracete, A. M., Fox, D. K., and Simms, D. (1998) Focus 20, 82; Sewall, A. and McRae, S. (1998) Focus 20, 36; Anal Biochem 1984 April; 138(1):141-3, A method for the quantitative recovery of protein in dilute solution in the presence of detergents and lipids; Wessel D, Flugge U I. (1984) Anal Biochem. 1984 April; 138(1):141-143.

The assay itself may be a cell sorting assay in which cells are sorted and/or counted based on cell surface expression of a protein marker. (See Cantor et al. 1975, Galbraith et al 1999)

Obtaining Expression Patterns

Expression patterns, or profiles, of a plurality of nucleotides corresponding to members of the candidate library are then evaluated in one or more samples of leukocytes. Typically, the leukocytes are derived from patient peripheral blood samples, although, as indicated above, many other sample sources are also suitable. These expression patterns constitute a set of relative or absolute expression values for a some number of RNAs or protein products corresponding to the plurality of nucleotide sequences evaluated, which is referred to herein as the subject's "expression profile" for those nucleotide sequences. While expression patterns for as few as one independent member of the candidate library can be obtained, it is generally preferable to obtain expression patterns corresponding to a larger number of nucleotide sequences, e.g., about 2, about 5, about 10, about 20, about 50, about 100, about 200, about 500, or about 1000, or more. The expression pattern for each differentially expressed component member of the library provides a finite specificity and sensitivity with respect to predictive value, e.g., for diagnosis, prognosis, monitoring, and the like.

Clinical Studies, Data and Patient Groups

For the purpose of discussion, the term subject, or subject sample of leukocytes, refers to an individual regardless of health and/or disease status. A subject can be a patient, a study participant, a control subject, a screening subject, or any other class of individual from whom a leukocyte sample is obtained and assessed in the context of the invention. Accordingly, a subject can be diagnosed with a disease, can present with one or more symptom of a disease, or a predisposing factor, such as a family (genetic) or medical history (medical) factor, for a disease, or the like. Alternatively, a subject can be healthy with respect to any of the aforementioned factors or criteria. It will be appreciated that the term "healthy" as used herein, is relative to a specified disease, or disease factor, or disease criterion, as the term "healthy" cannot be defined to correspond to any absolute evaluation or status. Thus, an individual defined as healthy with reference to any specified disease or disease criterion, can in fact be diagnosed with any other one or more disease, or exhibit any other one or more disease criterion.

Furthermore, while the discussion of the invention focuses, and is exemplified using human sequences and samples, the invention is equally applicable, through construction or selection of appropriate candidate libraries, to non-human animals, such as laboratory animals, e.g., mice, rats, guinea pigs, rabbits; domesticated livestock, e.g., cows, horses, goats, sheep, chicken, etc.; and companion animals, e.g., dogs, cats, etc.

Methods for Obtaining Expression Data

Numerous methods for obtaining expression data are known, and any one or more of these techniques, singly or in combination, are suitable for determining expression profiles in the context of the present invention. For example, expression patterns can be evaluated by northern analysis, PCR, RT-PCR, Taq Man analysis, FRET detection, monitoring one or more molecular beacon, hybridization to an oligonucleotide array, hybridization to a cDNA array, hybridization to a polynucleotide array, hybridization to a liquid microarray, hybridization to a microelectric array, molecular beacons, cDNA sequencing, clone hybridization, cDNA fragment fingerprinting, serial analysis of gene expression (SAGE), subtractive hybridization, differential display and/or differential screening (see, e.g., Lockhart and Winzeler (2000) Nature 405:827-836, and references cited therein).

For example, specific PCR primers are designed to a member(s) of an candidate nucleotide library. cDNA is prepared from subject sample RNA by reverse transcription from a poly-dT oligonucleotide primer, and subjected to PCR. Double stranded cDNA may be prepared using primers suitable for reverse transcription of the PCR product, followed by amplification of the cDNA using in vitro transcription. The product of in vitro transcription is a sense-RNA corresponding to the original member(s) of the candidate library. PCR product may be also be evaluated in a number of ways known in the art, including real-time assessment using detection of labeled primers, e.g. TaqMan or molecular beacon probes. Technology platforms suitable for analysis of PCR products include the ABI 7700, 5700, or 7000 Sequence Detection Systems (Applied Biosystems, Foster City, Calif.), the MJ Research Opticon (MJ Research, Waltham, Mass.), the Roche Light Cycler (Roche Diagnositics, Indianapolis, Ind.), the Stratagene MX4000 (Stratagene, La Jolla, Calif.), and the Bio-Rad iCycler (Bio-Rad Laboratories, Hercules, Calif.).

Alternatively, molecular beacons are used to detect presence of a nucleic acid sequence in an unamplified RNA or cDNA sample, or following amplification of the sequence using any method, e.g. IVT (In Vitro transcription) or NASBA (nucleic acid sequence based amplification). Molecular beacons are designed with sequences complementary to member(s) of an candidate nucleotide library, and are linked to fluorescent labels. Each probe has a different fluorescent label with non-overlapping emission wavelengths. For example, expression of ten genes may be assessed using ten different sequence-specific molecular beacons.

Alternatively, or in addition, molecular beacons are used to assess expression of multiple nucleotide sequences at once. Molecular beacons with sequence complimentary to the members of a diagnostic nucleotide set are designed and linked to fluorescent labels. Each fluorescent label used must have a non-overlapping emission wavelength. For example, 10 nucleotide sequences can be assessed by hybridizing 10 sequence specific molecular beacons (each labeled with a different fluorescent molecule) to an amplified or un-amplified RNA or cDNA sample. Such an assay bypasses the need for sample labeling procedures.

Alternatively, or in addition bead arrays can be used to assess expression of multiple sequences at once. See, e.g., LabMAP 100, Luminex Corp, Austin, Tex.). Alternatively, or in addition electric arrays are used to assess expression of multiple sequences, as exemplified by the e-Sensor technology of Motorola (Chicago, Ill.) or Nanochip technology of Nanogen (San Diego, Calif.)

Of course, the particular method elected will be dependent on such factors as quantity of RNA recovered, practitioner preference, available reagents and equipment, detectors, and the like. Typically, however, the elected method(s) will be appropriate for processing the number of samples and probes of interest. Methods for high-throughput expression analysis are discussed below.

Alternatively, expression at the level of protein products of gene expression is performed. For example, protein expression, in a sample of leukocytes, can be evaluated by one or more method selected from among: western analysis, two-dimensional gel analysis, chromatographic separation, mass spectrometric detection, protein-fusion reporter constructs, colorimetric assays, binding to a protein array and characterization of polysomal mRNA. One particularly favorable approach involves binding of labeled protein expression products to an array of antibodies specific for members of the candidate library. Methods for producing and evaluating antibodies are widespread in the art, see, e.g., Coligan, supra; and Harlow and Lane (1989) Antibodies: A Laboratory Manual, Cold Spring Harbor Press, NY ("Harlow and Lane"). Additional details regarding a variety of immunological and immunoassay procedures adaptable to the present invention by selection of antibody reagents specific for the products of candidate nucleotide sequences can be found in, e.g., Stites and Terr (eds.)(1991) Basic and Clinical Immunology, $7^{th}$ ed., and Paul, supra. Another approach uses systems for performing desorption spectrometry. Commercially available systems, e.g., from Ciphergen Biosystems, Inc. (Fremont, Calif.) are particularly well suited to quantitative analysis of protein expression. Indeed, Protein Chip® arrays (see, e.g., the web site ciphergen.com) used in desorption spectrometry approaches provide arrays for detection of protein expression. Alternatively, affinity reagents, e.g., antibodies, small molecules, etc.) are developed that recognize epitopes of the protein product. Affinity assays are used in protein array assays, e.g. to detect the presence or absence of particular proteins. Alternatively, affinity reagents are used to detect expression using the methods described above. In the case of a protein that is expressed on the cell surface of leukocytes, labeled affinity reagents are bound to populations of leukocytes, and leukocytes expressing the protein are identified and counted using fluorescent activated cell sorting (FACS).

It is appreciated that the methods of expression evaluation discussed herein, although discussed in the context of discovery of diagnostic nucleotide sets, are equally applicable for expression evaluation when using diagnostic nucleotide sets for, e.g. diagnosis of diseases, as further discussed below.

High Throughput Expression Assays

A number of suitable high throughput formats exist for evaluating gene expression. Typically, the term high throughput refers to a format that performs at least about 100 assays, or at least about 500 assays, or at least about 1000 assays, or at least about 5000 assays, or at least about 10,000 assays, or more per day. When enumerating assays, either the number of samples or the number of candidate nucleotide sequences evaluated can be considered. For example, a northern analysis of, e.g., about 100 samples performed in a gridded array, e.g., a dot blot, using a single probe corresponding to an candidate nucleotide sequence can be considered a high throughput assay. More typically, however, such an assay is performed as a series of duplicate blots, each evaluated with a distinct probe corresponding to a different member of the candidate library. Alternatively, methods that simultaneously evaluate expression of about 100 or more candidate nucleotide sequences in one or more samples, or in multiple samples, are considered high throughput.

Numerous technological platforms for performing high throughput expression analysis are known. Generally, such methods involve a logical or physical array of either the subject samples, or the candidate library, or both. Common array formats include both liquid and solid phase arrays. For example, assays employing liquid phase arrays, e.g., for hybridization of nucleic acids, binding of antibodies or other receptors to ligand, etc., can be performed in multiwell, or microtiter, plates. Microtiter plates with 96, 384 or 1536 wells are widely available, and even higher numbers of wells, e.g., 3456 and 9600 can be used. In general, the choice of microtiter plates is determined by the methods and equipment, e.g., robotic handling and loading systems, used for sample preparation and analysis. Exemplary systems include, e.g., the ORCA™ system from Beckman-Coulter, Inc. (Fullerton, Calif.) and the Zymate systems from Zymark Corporation (Hopkinton, Mass.).

Alternatively, a variety of solid phase arrays can favorably be employed in to determine expression patterns in the context of the invention. Exemplary formats include membrane or filter arrays (e.g., nitrocellulose, nylon), pin arrays, and bead arrays (e.g., in a liquid "slurry"). Typically, probes corresponding to nucleic acid or protein reagents that specifically interact with (e.g., hybridize to or bind to) an expression product corresponding to a member of the candidate library are immobilized, for example by direct or indirect cross-linking, to the solid support. Essentially any solid support capable of withstanding the reagents and conditions necessary for performing the particular expression assay can be utilized. For example, functionalized glass, silicon, silicon dioxide, modified silicon, any of a variety of polymers, such as (poly)tetrafluoroethylene, (poly)vinylidenedifluoride, polystyrene, polycarbonate, or combinations thereof can all serve as the substrate for a solid phase array.

In a preferred embodiment, the array is a "chip" composed, e.g., of one of the above specified materials. Polynucleotide probes, e.g., RNA or DNA, such as cDNA, synthetic oligonucleotides, and the like, or binding proteins such as antibodies, that specifically interact with expression products of individual components of the candidate library are affixed to the chip in a logically ordered manner, i.e., in an array. In addition, any molecule with a specific affinity for either the sense or anti-sense sequence of the marker nucleotide sequence (depending on the design of the sample labeling), can be fixed to the array surface without loss of specific affinity for the marker and can be obtained and produced for array production, for example, proteins that specifically recognize the specific nucleic acid sequence of the marker, ribozymes, peptide nucleic acids (PNA), or other chemicals or molecules with specific affinity.

Detailed discussion of methods for linking nucleic acids and proteins to a chip substrate, are found in, e.g., U.S. Pat. No. 5,143,854 "LARGE SCALE PHOTOLITHOGRAPHIC SOLID PHASE SYNTHESIS OF POLYPEPTIDES AND RECEPTOR BINDING SCREENING THEREOF" to Pirrung et al., issued, Sep. 1, 1992; U.S. Pat. No. 5,837,832 "ARRAYS OF NUCLEIC ACID PROBES ON BIOLOGICAL CHIPS" to Chee et al., issued Nov. 17, 1998; U.S. Pat. No. 6,087,112 "ARRAYS WITH MODIFIED OLIGONUCLEOTIDE AND POLYNUCLEOTIDE COMPOSITIONS" to Dale, issued Jul. 11, 2000; U.S. Pat. No. 5,215,882 "METHOD OF IMMOBILIZING NUCLEIC ACID ON A SOLID SUBSTRATE FOR USE IN NUCLEIC ACID HYBRIDIZATION ASSAYS" to Bahl et al., issued Jun. 1, 1993; U.S. Pat. No. 5,707,807 "MOLECULAR INDEXING FOR EXPRESSED GENE ANALYSIS" to Kato, issued Jan. 13, 1998; U.S. Pat. No. 5,807,522 "METHODS FOR FABRICATING MICROARRAYS OF BIOLOGICAL SAMPLES" to Brown et al., issued Sep. 15, 1998; U.S. Pat. No. 5,958,342 "JET DROPLET DEVICE" to Gamble et al., issued Sep. 28, 1999; U.S. Pat. No. 5,994,076 "METHODS OF ASSAYING DIFFERENTIAL EXPRESSION" to Chenchik et al., issued Nov. 30, 1999; U.S. Pat. No. 6,004,755 "QUANTITATIVE MICROARRAY HYBRIDIZATION ASSAYS" to Wang, issued Dec. 21, 1999; U.S. Pat. No. 6,048,695 "CHEMICALLY MODIFIED NUCLEIC ACIDS AND METHOD FOR COUPLING NUCLEIC ACIDS TO SOLID SUPPORT" to Bradley et al., issued Apr. 11, 2000; U.S. Pat. No. 6,060,240 "METHODS FOR MEASURING RELATIVE AMOUNTS OF NUCLEIC ACIDS IN A COMPLEX MIXTURE AND RETRIEVAL OF SPECIFIC SEQUENCES THEREFROM" to Kamb et al., issued May 9, 2000; U.S. Pat. No. 6,090,556 "METHOD FOR QUANTITATIVELY DETERMINING THE EXPRESSION OF A GENE" to Kato, issued Jul. 18, 2000; and U.S. Pat. No. 6,040,138 "EXPRESSION MONITORING BY HYBRIDIZATION TO HIGH DENSITY OLIGONUCLEOTIDE ARRAYS" to Lockhart et al., issued Mar. 21, 2000 each of which are hereby incorporated by reference in their entirety.

For example, cDNA inserts corresponding to candidate nucleotide sequences, in a standard TA cloning vector are amplified by a polymerase chain reaction for approximately 30-40 cycles. The amplified PCR products are then arrayed onto a glass support by any of a variety of well known techniques, e.g., the VSLIPS™ technology described in U.S. Pat. No. 5,143,854. RNA, or cDNA corresponding to RNA, isolated from a subject sample of leukocytes is labeled, e.g., with a fluorescent tag, and a solution containing the RNA (or cDNA) is incubated under conditions favorable for hybridization, with the "probe" chip. Following incubation, and washing to eliminate non-specific hybridization, the labeled nucleic acid bound to the chip is detected qualitatively or quantitatively, and the resulting expression profile for the corresponding candidate nucleotide sequences is recorded. It is appreciated that the probe used for diagnostic purposes may be identical to the probe used during diagnostic nucleotide sequence discovery and validation. Alternatively, the probe sequence may be different than the sequence used in diagnostic nucleotide sequence discovery and validation. Multiple cDNAs from a nucleotide sequence that are non-overlapping or partially overlapping may also be used.

In another approach, oligonucleotides corresponding to members of an candidate nucleotide library are synthesized and spotted onto an array. Alternatively, oligonucleotides are synthesized onto the array using methods known in the art, e.g. Hughes, et al. supra. The oligonucleotide is designed to be complementary to any portion of the candidate nucleotide sequence. In addition, in the context of expression analysis for, e.g. diagnostic use of diagnostic nucleotide sets, an oligonucleotide can be designed to exhibit particular hybridization characteristics, or to exhibit a particular specificity and/or sensitivity, as further described below.

Hybridization signal may be amplified using methods known in the art, and as described herein, for example use of the Clontech kit (Glass Fluorescent Labeling Kit), Stratagene kit (Fairplay Microarray Labeling Kit), the Micromax kit (New England Nuclear, Inc.), the Genisphere kit (3DNA Submicro), linear amplification, e.g. as described in U.S. Pat. No. 6,132,997 or described in Hughes, T R, et al., Nature Biotechnology, 19:343-347 (2001) and/or Westin et al. *Nat Biotech.* 18:199-204.

Alternatively, fluorescently labeled cDNA are hybridized directly to the microarray using methods known in the art. For example, labeled cDNA are generated by reverse transcription using Cy3- and Cy5-conjugated deoxynucleotides, and the reaction products purified using standard methods. It is appreciated that the methods for signal amplification of expression data useful for identifying diagnostic nucleotide sets are also useful for amplification of expression data for diagnostic purposes.

Microarray expression may be detected by scanning the microarray with a variety of laser or CCD-based scanners, and extracting features with numerous software packages, for example, Imagene (Biodiscovery), Feature Extraction (Agilent), Scanalyze (Eisen, M. 1999. SCANALYZE User Manual; Stanford Univ., Stanford, Calif. Ver 2.32.), GenePix (Axon Instruments).

In another approach, hybridization to microelectric arrays is performed, e.g. as described in Umek et al (2001) *J Mol Diagn.* 3:74-84. An affinity probe, e.g. DNA, is deposited on a metal surface. The metal surface underlying each probe is connected to a metal wire and electrical signal detection system. Unlabelled RNA or cDNA is hybridized to the array, or alternatively, RNA or cDNA sample is amplified before hybridization, e.g. by PCR. Specific hybridization of sample RNA or cDNA results in generation of an electrical signal, which is transmitted to a detector. See Westin (2000) *Nat Biotech.* 18:199-204 (describing anchored multiplex amplification of a microelectronic chip array); Edman (1997) *NAR* 25:4907-14; Vignali (2000) *J Immunol Methods* 243:243-55.

In another approach, a microfluidics chip is used for RNA sample preparation and analysis. This approach increases efficiency because sample preparation and analysis are streamlined. Briefly, microfluidics may be used to sort specific leukocyte sub-populations prior to RNA preparation and analysis. Microfluidics chips are also useful for, e.g., RNA preparation, and reactions involving RNA (reverse transcription, RT-PCR). Briefly, a small volume of whole, anti-coagulated blood is loaded onto a microfluidics chip, for example chips available from Caliper (Mountain View, Calif.) or Nanogen (San Diego, Calif.) A microfluidics chip may contain channels and reservoirs in which cells are moved and reactions are performed. Mechanical, electrical, magnetic, gravitational, centrifugal or other forces are used to move the cells and to expose them to reagents. For example, cells of whole blood are moved into a chamber containing hypotonic saline, which results in selective lysis of red blood cells after a 20-minute incubation. Next, the remaining cells (leukocytes) are moved into a wash chamber and finally, moved into a chamber containing a lysis buffer such as guanidine isothyocyanate. The leukocyte cell lysate is further processed for RNA isolation in the chip, or is then removed for further processing, for example, RNA extraction by standard methods. Alternatively, the microfluidics chip is a circular disk containing ficoll or another density reagent. The blood sample is injected into the center of the disc, the disc is rotated at a speed that generates a centrifugal force appropriate for density gradient separation of mononuclear cells, and the separated mononuclear cells are then harvested for further analysis or processing.

It is understood that the methods of expression evaluation, above, although discussed in the context of discovery of diagnostic nucleotide sets, are also applicable for expression evaluation when using diagnostic nucleotide sets for, e.g. diagnosis of diseases, as further discussed below.

Evaluation of Expression Patterns

Expression patterns can be evaluated by qualitative and/or quantitative measures. Certain of the above described techniques for evaluating gene expression (as RNA or protein products) yield data that are predominantly qualitative in nature. That is, the methods detect differences in expression that classify expression into distinct modes without providing significant information regarding quantitative aspects of expression. For example, a technique can be described as a qualitative technique if it detects the presence or absence of expression of an candidate nucleotide sequence, i.e., an on/off pattern of expression. Alternatively, a qualitative technique measures the presence (and/or absence) of different alleles, or variants, of a gene product.

In contrast, some methods provide data that characterizes expression in a quantitative manner. That is, the methods relate expression on a numerical scale, e.g., a scale of 0-5, a scale of 1-10, a scale of +-+++, from grade 1 to grade 5, a grade from a to z, or the like. It will be understood that the numerical, and symbolic examples provided are arbitrary, and that any graduated scale (or any symbolic representation of a graduated scale) can be employed in the context of the present invention to describe quantitative differences in nucleotide sequence expression. Typically, such methods yield information corresponding to a relative increase or decrease in expression.

Any method that yields either quantitative or qualitative expression data is suitable for evaluating expression of candidate nucleotide sequence in a subject sample of leukocytes. In some cases, e.g., when multiple methods are employed to determine expression patterns for a plurality of candidate nucleotide sequences, the recovered data, e.g., the expression profile, for the nucleotide sequences is a combination of quantitative and qualitative data.

In some applications, expression of the plurality of candidate nucleotide sequences is evaluated sequentially. This is typically the case for methods that can be characterized as low- to moderate-throughput. In contrast, as the throughput of the elected assay increases, expression for the plurality of candidate nucleotide sequences in a sample or multiple samples of leukocytes, is assayed simultaneously. Again, the methods (and throughput) are largely determined by the individual practitioner, although, typically, it is preferable to employ methods that permit rapid, e.g. automated or partially automated, preparation and detection, on a scale that is time-efficient and cost-effective.

It is understood that the preceding discussion, while directed at the assessment of expression of the members of candidate libraries, is also applies to the assessment of the expression of members of diagnostic nucleotide sets, as further discussed below.

Genotyping

In addition to, or in conjunction with the correlation of expression profiles and clinical data, it is often desirable to correlate expression patterns with the subject's genotype at one or more genetic loci. The selected loci can be, for example, chromosomal loci corresponding to one or more member of the candidate library, polymorphic alleles for marker loci, or alternative disease related loci (not contributing to the candidate library) known to be, or putatively associated with, a disease (or disease criterion). Indeed, it will be appreciated, that where a (polymorphic) allele at a locus is linked to a disease (or to a predisposition to a disease), the presence of the allele can itself be a disease criterion.

Numerous well known methods exist for evaluating the genotype of an individual, including southern analysis, restriction fragment length polymorphism (RFLP) analysis, polymerase chain reaction (PCR), amplification length polymorphism (AFLP) analysis, single stranded conformation polymorphism (SSCP) analysis, single nucleotide polymorphism (SNP) analysis (e.g., via PCR, Taqman or molecular beacons), among many other useful methods. Many such procedures are readily adaptable to high throughput and/or automated (or semi-automated) sample preparation and analysis methods. Most, can be performed on nucleic acid samples recovered via simple procedures from the same sample of leukocytes as yielded the material for expression profiling. Exemplary techniques are described in, e.g., Sambrook, and Ausubel, supra.

Identification of the Diagnostic Nucleotide Sets of the Invention

Identification of diagnostic nucleotide sets and disease specific target nucleotide sequence proceeds by correlating the leukocyte expression profiles with data regarding the subject's health status to produce a data set designated a "molecular signature." Examples of data regarding a patient's health status, also termed "disease criteria(ion)", is described below and in the Section titled "selected diseases," below. Methods useful for correlation analysis are further described elsewhere in the specification.

Generally, relevant data regarding the subject's health status includes retrospective or prospective health data, e.g., in the form of the subject's medical history, as provided by the subject, physician or third party, such as, medical diagnoses, laboratory test results, diagnostic test results, clinical events, or medication lists, as further described below. Such data may include information regarding a patient's response to treatment and/or a particular medication and data regarding the presence of previously characterized "risk factors." For example, cigarette smoking and obesity are previously identified risk factors for heart disease. Further examples of health status information, including diseases and disease criteria, is described in the section titled Selected diseases, below.

Typically, the data describes prior events and evaluations (i.e., retrospective data). However, it is envisioned that data collected subsequent to the sampling (i.e., prospective data) can also be correlated with the expression profile. The tissue sampled, e.g., peripheral blood, bronchial lavage, etc., can be obtained at one or more multiple time points and subject data is considered retrospective or prospective with respect to the time of sample procurement.

Data collected at multiple time points, called "longitudinal data", is often useful, and thus, the invention encompasses the analysis of patient data collected from the same patient at different time points. Analysis of paired samples, such as samples from a patient at different time, allows identification of differences that are specifically related to the disease state since the genetic variability specific to the patient is controlled for by the comparison. Additionally, other variables that exist between patients may be controlled for in this way, for example, the presence or absence of inflammatory diseases (e.g., rheumatoid arthritis) the use of medications that may effect leukocyte gene expression, the presence or absence of co-morbid conditions, etc. Methods for analysis of paired samples are further described below. Moreover, the analysis of a pattern of expression profiles (generated by collecting multiple expression profiles) provides information relating to changes in expression level over time, and may permit the determination of a rate of change, a trajectory, or an expression curve. Two longitudinal samples may provide information on the change in expression of a gene over time, while three longitudinal samples may be necessary to determine the "trajectory" of expression of a gene. Such information may be relevant to the diagnosis of a disease. For example, the expression of a gene may vary from individual to individual, but a clinical event, for example, a heart attack, may cause the level of expression to double in each patient. In this example, clinically interesting information is gleaned from the change in expression level, as opposed to the absolute level of expression in each individual.

When a single patient sample is obtained, it may still be desirable to compare the expression profile of that sample to some reference expression profile. In this case, one can determine the change of expression between the patient's sample and a reference expression profile that is appropriate for that patient and the medical condition in question. For example, a reference expression profile can be determined for all patients without the disease criterion in question who have similar characteristics, such as age, sex, race, diagnoses etc.

Generally, small sample sizes of 20-100 samples are used to identify a diagnostic nucleotide set. Larger sample sizes are generally necessary to validate the diagnostic nucleotide set for use in large and varied patient populations, as further described below. For example, extension of gene expression correlations to varied ethnic groups, demographic groups, nations, peoples or races may require expression correlation experiments on the population of interest.

Expression Reference Standards

Expression profiles derived from a patient (i.e., subjects diagnosed with, or exhibiting symptoms of, or exhibiting a disease criterion, or under a doctor's care for a disease) sample are compared to a control or standard expression RNA to facilitate comparison of expression profiles (e.g. of a set of candidate nucleotide sequences) from a group of patients relative to each other (i.e., from one patient in the group to other patients in the group, or to patients in another group).

The reference RNA used should have desirable features of low cost and simplicity of production on a large scale. Additionally, the reference RNA should contain measurable amounts of as many of the genes of the candidate library as possible.

For example, in one approach to identifying diagnostic nucleotide sets, expression profiles derived from patient samples are compared to a expression reference "standard."

Standard expression reference can be, for example, RNA derived from resting cultured leukocytes or commercially available reference RNA, such as Universal reference RNA from Stratagene. See Nature, V406, 8-17-00, p. 747-752. Use of an expression reference standard is particularly useful when the expression of large numbers of nucleotide sequences is assayed, e.g. in an array, and in certain other applications, e.g. qualitative PCR, RT-PCR, etc., where it is desirable to compare a sample profile to a standard profile, and/or when large numbers of expression profiles, e.g. a patient population, are to be compared. Generally, an expression reference standard should be available in large quantities, should be a good substrate for amplification and labeling reactions, and should be capable of detecting a large percentage of candidate nucleic acids using suitable expression profiling technology.

Alternatively, or in addition, the expression profile derived from a patient sample is compared with the expression of an internal reference control gene, for example, β-actin or CD4. The relative expression of the profiled genes and the internal reference control gene (from the same individual) is obtained. An internal reference control may also be used with a reference RNA. For example, an expression profile for "gene 1" and the gene encoding CD4 can be determined in a patient sample and in a reference RNA. The expression of each gene can be expressed as the "relative" ratio of expression the gene in the patient sample compared with expression of the gene in the reference RNA. The expression ratio (sample/reference) for gene 1 may be divided by the expression ration for CD4 (sample/reference) and thus the relative expression of gene 1 to CD4 is obtained.

The invention also provides a buffy coat control RNA useful for expression profiling, and a method of using control RNA produced from a population of buffy coat cells, the white blood cell layer derived from the centrifugation of whole blood. Buffy coat contains all white blood cells, including granulocytes, mononuclear cells and platelets. The invention also provides a method of preparing control RNA from buffy coat cells for use in expression profile analysis of leukocytes. Buffy coat fractions are obtained, e.g. from a blood bank or directly from individuals, preferably from a large number of individuals such that bias from individual samples is avoided and so that the RNA sample represents an average expression of a healthy population. Buffy coat fractions from about 50 or about 100, or more individuals are preferred. 10 ml buffy coat from each individual is used. Buffy coat samples are treated with an erthythrocyte lysis buffer, so that erthythrocytes are selectively removed. The leukocytes of the buffy coat layer are collected by centrifugation. Alternatively, the buffy cell sample can be further enriched for a particular leukocyte sub-populations, e.g. mononuclear cells, T-lymphocytes, etc. To enrich for mononuclear cells, the buffy cell pellet, above, is diluted in PBS (phosphate buffered saline) and loaded onto a non-polystyrene tube containing a polysucrose and sodium diatrizoate solution adjusted to a density of 1.077+/−0.001 g/ml. To enrich for T-lymphocytes, 45 ml of whole blood is treated with RosetteSep (Stem Cell Technologies), and incubated at room temperature for 20 minutes. The mixture is diluted with an equal volume of PBS plus 2% FBS and mixed by inversion. 30 ml of diluted mixture is layered on top of 15 ml DML medium (Stem Cell Technologies). The tube is centrifuged at 1200×g, and the enriched cell layer at the plasma:medium interface is removed, washed with PBS+2% FBS, and cells collected by centrifugation at 1200×g. The cell pellet is treated with 5 ml of erythrocyte lysis buffer (EL buffer, Qiagen) for 10 minutes on ice, and enriched T-lymphocytes are collected by centrifugation.

In addition or alternatively, the buffy cells (whole buffy coat or sub-population, e.g. mononuclear fraction) can be cultured in vitro and subjected to stimulation with cytokines or activating chemicals such as phorbol esters or ionomycin. Such stimuli may increase expression of nucleotide sequences that are expressed in activated immune cells and might be of interest for leukocyte expression profiling experiments.

Following sub-population selection and/or further treatment, e.g. stimulation as described above, RNA is prepared using standard methods. For example, cells are pelleted and lysed with a phenol/guanidinium thiocyanate and RNA is prepared. RNA can also be isolated using a silica gel-based purification column or the column method can be used on RNA isolated by the phenol/guanidinium thiocyanate method. RNA from individual buffy coat samples can be pooled during this process, so that the resulting reference RNA represents the RNA of many individuals and individual bias is minimized or eliminated. In addition, a new batch of buffy coat reference RNA can be directly compared to the last batch to ensure similar expression pattern from one batch to another, using methods of collecting and comparing expression profiles described above/below. One or more expression reference controls are used in an experiment. For example, RNA derived from one or more of the following sources can be used as controls for an experiment: stimulated or unstimulated whole buffy coat, stimulated or unstimulated peripheral mononuclear cells, or stimulated or unstimulated T-lymphocytes.

Alternatively, the expression reference standard can be derived from any subject or class of subjects including healthy subjects or subjects diagnosed with the same or a different disease or disease criterion. Expression profiles from subjects in two distinct classes are compared to determine which subset of nucleotide sequences in the candidate library best distinguish between the two subject classes, as further discussed below. It will be appreciated that in the present context, the term "distinct classes" is relevant to at least one distinguishable criterion relevant to a disease of interest, a "disease criterion." The classes can, of course, demonstrate significant overlap (or identity) with respect to other disease criteria, or with respect to disease diagnoses, prognoses, or the like. The mode of discovery involves, e.g., comparing the molecular signature of different subject classes to each other (such as patient to control, patients with a first diagnosis to patients with a second diagnosis, etc.) or by comparing the molecular signatures of a single individual taken at different time points. The invention can be applied to a broad range of diseases, disease criteria, conditions and other clinical and/or epidemiological questions, as further discussed above/below.

It is appreciated that while the present discussion pertains to the use of expression reference controls while identifying diagnostic nucleotide sets, expression reference controls are also useful during use of diagnostic nucleotide sets, e.g. use of a diagnostic nucleotide set for diagnosis of a disease, as further described below.

Analysis of Expression Profiles

In order to facilitate ready access, e.g., for comparison, review, recovery, and/or modification, the molecular signatures/expression profiles are typically recorded in a database. Most typically, the database is a relational database accessible by a computational device, although other formats, e.g., manually accessible indexed files of expression profiles as photographs, analogue or digital imaging readouts, spreadsheets, etc. can be used. Further details regarding preferred embodiments are provided below. Regardless of whether the expression patterns initially recorded are analog or digital in nature and/or whether they represent quantitative or qualitative differences in expression, the expression patterns, expression profiles (collective expression patterns), and molecular signatures (correlated expression patterns) are stored digitally and accessed via a database. Typically, the database is compiled and maintained at a central facility, with access being available locally and/or remotely.

As additional samples are obtained, and their expression profiles determined and correlated with relevant subject data, the ensuing molecular signatures are likewise recorded in the database. However, rather than each subsequent addition being added in an essentially passive manner in which the data from one sample has little relation to data from a second (prior or subsequent) sample, the algorithms optionally additionally query additional samples against the existing database to further refine the association between a molecular signature and disease criterion. Furthermore, the data set comprising the one (or more) molecular signatures is optionally queried against an expanding set of additional or other disease criteria. The use of the database in integrated systems and web embodiments is further described below.

Analysis of Expression Profile Data from Arrays

Expression data is analyzed using methods well known in the art, including the software packages Imagene (Biodiscovery, Marina del Rey, Calif.), Feature Extraction Software (Agilent, Palo Alto, Calif.), and Scanalyze (Stanford University). In the discussion that follows, a "feature" refers to an individual spot of DNA on an array. Each gene may be represented by more than one feature. For example, hybridized microarrays are scanned and analyzed on an Axon Instruments scanner using GenePix 3.0 software (Axon Instruments, Union City, Calif.). The data extracted by GenePix is used for all downstream quality control and expression evaluation. The data is derived as follows. The data for all features flagged as "not found" by the software is removed from the dataset for individual hybridizations. The "not found" flag by GenePix indicates that the software was unable to discriminate the feature from the background. Each feature is examined to determine the value of its signal. The median pixel intensity of the background ($B_n$) is subtracted from the median pixel intensity of the feature ($F_n$) to produce the background-subtracted signal (hereinafter, "BGSS"). The BGSS is divided by the standard deviation of the background pixels to provide the signal-to-noise ratio (hereinafter, "S/N"). Features with a S/N of three or greater in both the Cy3 channel (corresponding to the sample RNA) and Cy5 channel (corresponding to the reference RNA) are used for further analysis (hereinafter denoted "useable features"). Alternatively, different S/Ns are used for selecting expression data for an analysis. For example, only expression data with signal to noise ratios >3 might be used in an analysis. Alternatively, features with S/N values <3 may be flagged as such and included in the analysis. Such flagged data sets include more values and may allow one to discover expression markers that would be missed otherwise. However, such data sets may have a higher variability than filtered data, which may decrease significance of findings or performance of correlation statistics.

For each usable feature (i), the expression level (e) is expressed as the logarithm of the ratio (R) of the Background Subtracted Signal (hereinafter "BGSS") for the Cy3 (sample RNA) channel divided by the BGSS for the Cy5 channel (reference RNA) This "log ratio" value is used for comparison to other experiments.

$$R_i = \frac{BGSS_{sample}}{BGSS_{reference}} \tag{0.1}$$

$$e_i = \log r_1 \tag{0.2}$$

Variation in signal across hybridizations may be caused by a number of factors affecting hybridization, DNA spotting, wash conditions, and labeling efficiency.

A single reference RNA may be used with all of the experimental RNAs, permitting multiple comparisons in addition to individual comparisons. By comparing sample RNAs to the same reference, the gene expression levels from each sample are compared across arrays, permitting the use of a consistent denominator for our experimental ratios.

Alternative methods of analyzing the data may involve 1) using the sample channel without normalization by the reference channel, 2) using an intensity-dependent normalization based on the reference which provides a greater correction when the signal in the reference channel is large, 3) using the data without background subtraction or subtracting an empirically derived function of the background intensity rather than the background itself.

Scaling

The data may be scaled (normalized) to control for labeling and hybridization variability within the experiment, using methods known in the art. Scaling is desirable because it facilitates the comparison of data between different experiments, patients, etc. Generally the BGSS are scaled to a factor such as the median, the mean, the trimmed mean, and percentile. Additional methods of scaling include: to scale between 0 and 1, to subtract the mean, or to subtract the median.

Scaling is also performed by comparison to expression patterns obtained using a common reference RNA, as described in greater detail above. As with other scaling methods, the reference RNA facilitates multiple comparisons of the expression data, e.g., between patients, between samples, etc. Use of a reference RNA provides a consistent denominator for experimental ratios.

In addition to the use of a reference RNA, individual expression levels may be adjusted to correct for differences in labeling efficiency between different hybridization experiments, allowing direct comparison between experiments with different overall signal intensities, for example. A scaling factor ($\alpha$) may be used to adjust individual expression levels as follows. The median of the scaling factor ($\alpha$), for example, BGSS, is determined for the set of all features with a S/N greater than three. Next, the $BGSS_i$ (the BGSS for each feature "i") is divided by the median for all features ($\alpha$), generating a scaled ratio. The scaled ration is used to determine the expression value for the feature ($e_i$), or the log ratio.

$$S_i = \frac{BGSS_i}{a} \tag{0.3}$$

$$e_i = \log\left(\frac{Cy3S_i}{Cy5S_i}\right) \tag{0.4}$$

In addition, or alternatively, control features are used to normalize the data for labeling and hybridization variability within the experiment. Control feature may be cDNA for genes from the plant, *Arabidopsis thaliana*, that are included when spotting the mini-array. Equal amounts of RNA complementary to control cDNAs are added to each of the samples before they were labeled. Using the signal from these control genes, a normalization constant (L) is determined according to the following formula:

$$L_j = \frac{\sum_{i=1}^{N} BGSS_{j,i}}{\sum_{j=1}^{K} \frac{\sum_{i=1}^{N} BGSS_{j,i}}{N}}$$

where $BGSS_i$ is the signal for a specific feature, N is the number of *A. thaliana* control features, K is the number of hybridizations, and $L_j$ is the normalization constant for each individual hybridization.

Using the formula above, the mean for all control features of a particular hybridization and dye (e.g., Cy3) is calculated. The control feature means for all Cy3 hybridizations are averaged, and the control feature mean in one hybridization divided by the average of all hybridizations to generate a normalization constant for that particular Cy3 hybridization ($L_j$), which is used as a in equation (0.3). The same normalization steps may be performed for Cy3 and Cy5 values.

An alternative scaling method can also be used. The log of the ratio of Green/Red is determined for all features. The median log ratio value for all features is determined. The feature values are then scaled using the following formula: Log_Scaled_Feature_Ratio=Log_Feature_Ratio−Median_Log_Ratio.

Many additional methods for normalization exist and can be applied to the data. In one method, the average ratio of Cy3 BGSS/Cy5 BGSS is determined for all features on an array. This ratio is then scaled to some arbitrary number, such as 1 or some other number. The ratio for each probe is then multiplied by the scaling factor required to bring the average ratio to the chosen level. This is performed for each array in an analysis. Alternatively, the ratios are normalized to the average ratio across all arrays in an analysis. Other methods of normalization include forcing the distribution of signal strengths of the various arrays into greater agreement by transforming them to match certain points (quartiles, or deciles, etc.) in a standard distribution, or in the most extreme case using the rank of the signal of each oligonucleotide relative to the other oligonucleotides on the array.

If multiple features are used per gene sequence or oligonucleotide, these repeats can be used to derive an average expression value for each gene. If some of the replicate features are of poor quality and don't meet requirements for analysis, the remaining features can be used to represent the gene or gene sequence.

Correlation Analysis

Correlation analysis is performed to determine which array probes have expression behavior that best distinguishes or serves as markers for relevant groups of samples representing a particular clinical condition. Correlation analysis, or comparison among samples representing different disease criteria (e.g., clinical conditions), is performed using standard statistical methods. Numerous algorithms are useful for correlation analysis of expression data, and the selection of algorithms depends in part on the data analysis to be performed. For example, algorithms can be used to identify the single most informative gene with expression behavior that reliably classifies samples, or to identify all the genes useful to classify samples. Alternatively, algorithms can be applied that determine which set of 2 or more genes have collective expression behavior that accurately classifies samples. The use of multiple expression markers for diagnostics may overcome the variability in expression of a gene between individuals, or overcome the variability intrinsic to the assay. Multiple expression markers may include redundant markers (surrogates), in that two or more genes or probes may provide the same information with respect to diagnosis. This may occur, for example, when two or more genes or gene probes are coordinately expressed. For diagnostic application, it may be appropriate to utilize a gene and one or more of its surrogates in the assay. This redundancy may overcome failures (technical or biological) of a single marker to distinguish samples. Alternatively, one or more surrogates may have properties that make them more suitable for assay development, such as a higher baseline level of expression, better cell specificity, a higher fold change between sample groups or more specific sequence for the design of PCR primers or complimentary probes. It will be appreciated that while the discussion above pertains to the analysis of RNA expression profiles the discussion is equally applicable to the analysis of profiles of proteins or other molecular markers.

Prior to analysis, expression profile data may be formatted or prepared for analysis using methods known in the art. For example, often the log ratio of scaled expression data for every array probe is calculated using the following formula:

log (Cy 3 BGSS/Cy5 BGSS), where Cy 3 signal corresponds to the expression of the gene in the clinical sample, and Cy5 signal corresponds to expression of the gene in the reference RNA.

Data may be further filtered depending on the specific analysis to be done as noted below. For example, filtering may be aimed at selecting only samples with expression above a certain level, or probes with variability above a certain level between sample sets.

The following non-limiting discussion consider several statistical methods known in the art. Briefly, the t-test and ANOVA are used to identify single genes with expression differences between or among populations, respectively. Multivariate methods are used to identify a set of two or more genes for which expression discriminates between two disease states more specifically than expression of any single gene.

t-test

The simplest measure of a difference between two groups is the Student's t test. See, e.g., Welsh et al. (2001) Proc *Natl Acad Sci USA* 98:1176-81 (demonstrating the use of an unpaired Student's t-test for the discovery of differential gene expression in ovarian cancer samples and control tissue samples). The t-test assumes equal variance and normally distributed data. This test identifies the probability that there is a difference in expression of a single gene between two groups of samples. The number of samples within each group that is required to achieve statistical significance is dependent upon the variation among the samples within each group. The standard formula for a t-test is:

$$t(e_i) = \frac{\overline{e}_{i,c} - \overline{e}_{i,t}}{\sqrt{(s_{i,c}^2/n_c) + (s_{i,t}^2/n_t)}}, \quad (0.5)$$

where $\overline{e}_i$ is the difference between the mean expression level of gene i in groups c and t, $s_{i,c}$ is the variance of gene x in group c and $s_{i,t}$ is the variance of gene x in group t. $n_c$ and $n_t$ are the numbers of samples in groups c and t.

The combination of the t statistic and the degrees of freedom [min($n_t$, $n_c$)–1] provides a p value, the probability of rejecting the null hypothesis. A p-value of $\leq 0.01$, signifying a 99 percent probability the mean expression levels are different between the two groups (a 1% chance that the mean expression levels are in fact not different and that the observed difference occurred by statistical chance), is often considered acceptable.

When performing tests on a large scale, for example, on a large dataset of about 8000 genes, a correction factor must be included to adjust for the number of individual tests being performed. The most common and simplest correction is the Bonferroni correction for multiple tests, which divides the p-value by the number of tests run. Using this test on an 8000 member dataset indicates that a p value of $\leq 0.00000125$ is required to identify genes that are likely to be truly different between the two test conditions.

Significance Analysis for Microarrays (SAM)

Significance analysis for microarrays (SAM) (Tusher 2001) is a method through which genes with a correlation between their expression values and the response vector are statistically discovered and assigned a statistical significance. The ratio of false significant to significant genes is the False Discovery Rate (FDR). This means that for each threshold there are a set of genes which are called significant, and the FDR gives a confidence level for this claim. If a gene is called differentially expressed between 2 classes by SAM, with a FDR of 5%, there is a 95% chance that the gene is actually differentially expressed between the classes. SAM takes into account the variability and large number of variables of microarrays. SAM will identify genes that are most globally differentially expressed between the classes. Thus, important genes for identifying and classifying outlier samples or patients may not be identified by SAM.

Non-Parametric Tests

Wilcoxon's signed ranks method is one example of a non-parametric test and is utilized for paired comparisons. See e.g., Sokal and Rohlf (1987) *Introduction to Biostatistics* 2$^{nd}$ edition, WH Freeman, New York. At least 6 pairs are necessary to apply this statistic. This test is useful for analysis of paired expression data (for example, a set of patients who have cardiac transplant biopsy on 2 occasions and have a grade 0 on one occasion and a grade 3A on another). The Fisher Exact Test with a threshold and the Mann-Whitney Test are other non-parametric tests that may be used.

ANOVA

Differences in gene expression across multiple related groups may be assessed using an Analysis of Variance (ANOVA), a method well known in the art (Michelson and Schofield, 1996).

Multivariate Analysis

Many algorithms suitable for multivariate analysis are known in the art. Generally, a set of two or more genes for which expression discriminates between two disease states more specifically than expression of any single gene is identified by searching through the possible combinations of genes using a criterion for discrimination, for example the expression of gene X must increase from normal 300 percent, while the expression of genes Y and Z must decrease from normal by 75 percent. Ordinarily, the search starts with a single gene, then adds the next best fit at each step of the search. Alternatively, the search starts with all of the genes and genes that do not aid in the discrimination are eliminated step-wise.

Paired Samples

Paired samples, or samples collected at different time-points from the same patient, are often useful, as described above. For example, use of paired samples permits the reduction of variation due to genetic variation among individuals. In addition, the use of paired samples has a statistical significance, in that data derived from paired samples can be calculated in a different manner that recognizes the reduced variability. For example, the formula for a t-test for paired samples is:

$$t(e_x) = \frac{\overline{D}_{ex}}{\sqrt{\frac{\sum D^2 - (\sum D)^2 / b}{b - 1}}}, \qquad (0.5)$$

where D is the difference between each set of paired samples and b is the number of sample pairs. $\overline{D}$ is the mean of the differences between the members of the pairs. In this test, only the differences between the paired samples are considered, then grouped together (as opposed to taking all possible differences between groups, as would be the case with an ordinary t-test). Additional statistical tests useful with paired data, e.g., ANOVA and Wilcoxon's signed rank test, are discussed above.

Diagnostic Classification

Once a discriminating set of genes is identified, the diagnostic classifier (a mathematical function that assigns samples to diagnostic categories based on expression data) is applied to unknown sample expression levels.

Methods that can be used for this analysis include the following non-limiting list:

CLEAVER is an algorithm used for classification of useful expression profile data. See Raychaudhuri et al. (2001) *Trends Biotechnol* 19:189-193. CLEAVER uses positive training samples (e.g., expression profiles from samples known to be derived from a particular patient or sample diagnostic category, disease or disease criteria), negative training samples (e.g., expression profiles from samples known not to be derived from a particular patient or sample diagnostic category, disease or disease criteria) and test samples (e.g., expression profiles obtained from a patient), and determines whether the test sample correlates with the particular disease or disease criteria, or does not correlate with a particular disease or disease criteria. CLEAVER also generates a list of the 20 most predictive genes for classification.

Artificial neural networks (hereinafter, "ANN") can be used to recognize patterns in complex data sets and can discover expression criteria that classify samples into more than 2 groups. The use of artificial neural networks for discovery of gene expression diagnostics for cancers using expression data generated by oligonucleotide expression microarrays is demonstrated by Khan et al. (2001) *Nature Med.* 7:673-9. Khan found that 96 genes provided 0% error rate in classification of the tumors. The most important of these genes for classification was then determined by measuring the sensitivity of the classification to a change in expression of each gene. Hierarchical clustering using the 96 genes results in correct grouping of the cancers into diagnostic categories.

Golub uses cDNA microarrays and a distinction calculation to identify genes with expression behavior that distinguishes myeloid and lymphoid leukemias. See Golub et al. (1999) *Science* 286:531-7. Self organizing maps were used for new class discovery. Cross validation was done with a "leave one out" analysis. 50 genes were identified as useful markers. This was reduced to as few as 10 genes with equivalent diagnostic accuracy.

Hierarchical and non-hierarchical clustering methods are also useful for identifying groups of genes that correlate with a subset of clinical samples such as with transplant rejection grade. Alizadeh used hierarchical clustering as the primary tool to distinguish different types of diffuse B-cell lymphomas based on gene expression profile data. See Alizadeh et al. (2000) Nature 403:503-11. Alizadeh used hierarchical clustering as the primary tool to distinguish different types of diffuse B-cell lymphomas based on gene expression profile data. A cDNA array carrying 17856 probes was used for these experiments, 96 samples were assessed on 128 arrays, and a set of 380 genes was identified as being useful for sample classification.

Perou demonstrates the use of hierarchical clustering for the molecular classification of breast tumor samples based on expression profile data. See Perou et al. (2000) Nature 406: 747-52. In this work, a cDNA array carrying 8102 gene probes was used. 1753 of these genes were found to have high variation between breast tumors and were used for the analysis.

Hastie describes the use of gene shaving for discovery of expression markers. Hastie et al. (2000) Genome Biol. 1(2): RESEARCH 0003.1-0003.21. The gene shaving algorithm identifies sets of genes with similar or coherent expression patterns, but large variation across conditions (RNA samples, sample classes, patient classes). In this manner, genes with a tight expression pattern within a transplant rejection grade, but also with high variability across rejection grades are grouped together. The algorithm takes advantage of both characteristics in one grouping step. For example, gene shaving can identify useful marker genes with co-regulated expression. Sets of useful marker genes can be reduced to a smaller set, with each gene providing some non-redundant value in classification. This algorithm was used on the data set described in Alizadeh et al., supra, and the set of 380 informative gene markers was reduced to 234.

Supervised harvesting of expression trees (Hastie 2001) identifies genes or clusters that best distinguish one class from all the others on the data set. The method is used to identify the genes/clusters that can best separate one class versus all the others for datasets that include two or more classes or all classes from each other. This algorithm can be used for discovery or testing of a diagnostic gene set.

CART is a decision tree classification algorithm (Breiman 1984). From gene expression and or other data, CART can develop a decision tree for the classification of samples. Each node on the decision tree involves a query about the expression level of one or more genes or variables. Samples that are above the threshold go down one branch of the decision tree and samples that are not go down the other branch. See example 4 for further description of its use in classification analysis and examples of its usefulness in discovering and implementing a diagnostic gene set. CART identifies surrogates for each splitter (genes that are the next best substitute for a useful gene in classification.

Multiple Additive Regression Trees (Friedman, J H 1999, MART) is similar to CART in that it is a classification algorithm that builds decision trees to distinguish groups. MART builds numerous trees for any classification problem and the resulting model involves a combination of the multiple trees. MART can select variables as it build models and thus can be used on large data sets, such as those derived from an 8000 gene microarray. Because MART uses a combination of many trees and does not take too much information from any one tree, it resists over training. MART identifies a set of genes and an algorithm for their use as a classifier.

A Nearest Shrunken Centroids Classifier can be applied to microarray or other data sets by the methods described by Tibshirani et al. 2002. This algorithms also identified gene sets for classification and determines their 10 fold cross validation error rates for each class of samples. The algorithm determines the error rates for models of any size, from one gene to all genes in the set. The error rates for either or both sample classes can are minimized when a particular number of genes are used. When this gene number is determined, the algorithm associated with the selected genes can be identified and employed as a classifier on prospective sample.

Once a set of genes and expression criteria for those genes have been established for classification, cross validation is done. There are many approaches, including a 10 fold cross validation analysis in which 10% of the training samples are left out of the analysis and the classification algorithm is built with the remaining 90%. The 10% are then used as a test set for the algorithm. The process is repeated 10 times with 10% of the samples being left out as a test set each time. Through this analysis, one can derive a cross validation error which helps estimate the robustness of the algorithm for use on prospective (test) samples.

Clinical data are gathered for every patient sample used for expression analysis. Clinical variables can be quantitative or non-quantitative. A clinical variable that is quantitative can be used as a variable for significance or classification analysis. Non-quantitative clinical variables, such as the sex of the patient, can also be used in a significance analysis or classification analysis with some statistical tool. It is appreciated that the most useful diagnostic gene set for a condition may be optimal when considered along with one or more predictive clinical variables. Clinical data can also be used as supervising vectors for a correlation analysis. That is to say that the clinical data associated with each sample can be used to divide the samples into meaningful diagnostic categories for analysis. For example, samples can be divided into 2 or more groups based on the presence or absence of some diagnostic criterion (a). In addition, clinical data can be utilized to select patients for a correlation analysis or to exclude them based on some undesirable characteristic, such as an ongoing infection, a medicine or some other issue. Clinical data can also be used to assess the pre-test probability of an outcome. For example, patients who are female are much more likely to be diagnosed as having systemic lupus erythematosis than patients who are male.

Once a set of genes are identified that classify samples with acceptable accuracy. These genes are validated as a set using new samples that were not used to discover the gene set. These samples can be taken from frozen archives from the discovery clinical study or can be taken from new patients prospectively. Validation using a "test set" of samples can be done using expression profiling of the gene set with microarrays or using real-time PCR for each gene on the test set samples. Alternatively, a different expression profiling technology can be used.

Immune Monitoring

Leukocyte gene expression can be used to monitor the immune system. Immune monitoring examines both the level of gene expression for a set of genes in a given cell type and for genes which are expressed in a cell type selective manner gene expression monitoring will also detect the presence or absence of new cell types, progenitor cells, differentiation of cells and the like. Gene expression patterns may be associated with activation or the resting state of cells of the immune system that are responsible for or responsive to a disease state.

For example, in the process of transplant rejection, cells of the immune system are activated by the presence of the foreign tissue. Genes and gene sets that monitor and diagnose this process are providing a measure of the level and type of activation of the immune system. Genes and gene sets that are useful in monitoring the immune system may be useful for diagnosis and monitoring of all diseases that involve the immune system. Some examples are transplant rejection, rheumatoid arthritis, lupus, inflammatory bowel diseases, multiple sclerosis, HIV/AIDS, and viral, bacterial and fungal infection. All disorders and diseases disclosed herein are contemplated. Genes and gene sets that monitor immune activation are useful for monitoring response to immunosuppressive drug therapy, which is used to decrease immune activation. Genes are found to correlate with immune activation by correlation of expression patterns to the known presence of immune activation or quiescence in a sample as determined by some other test.

Selected Diseases

In principle, diagnostic nucleotide sets of the invention may be developed and applied to essentially any disease, or disease criterion, as long as at least one subset of nucleotide sequences is differentially expressed in samples derived from one or more individuals with a disease criteria or disease and one or more individuals without the disease criteria or disease, wherein the individual may be the same individual sampled at different points in time, or the individuals may be different individuals (or populations of individuals). For example, the subset of nucleotide sequences may be differentially expressed in the sampled tissues of subjects with the disease or disease criterion (e.g., a patient with a disease or disease criteria) as compared to subjects without the disease or disease criterion (e.g., patients without a disease (control patients)). Alternatively, or in addition, the subset of nucleotide sequence(s) may be differentially expressed in different samples taken from the same patient, e.g. at different points in time, at different disease stages, before and after a treatment, in the presence or absence of a risk factor, etc.

Expression profiles corresponding to sets of nucleotide sequences that correlate not with a diagnosis, but rather with a particular aspect of a disease can also be used to identify the diagnostic nucleotide sets and disease specific target nucleotide sequences of the invention. For example, such an aspect, or disease criterion, can relate to a subject's medical or family history, e.g., childhood illness, cause of death of a parent or other relative, prior surgery or other intervention, medications, symptoms (including onset and/or duration of symptoms), etc. Alternatively, the disease criterion can relate to a diagnosis, e.g., hypertension, diabetes, atherosclerosis, or prognosis (e.g., prediction of future diagnoses, events or complications), e.g., acute myocardial infarction, restenosis following angioplasty, reperfusion injury, allograft rejection, rheumatoid arthritis or systemic lupus erythematosis disease activity or the like. In other cases, the disease criterion corresponds to a therapeutic outcome, e.g., transplant rejection, bypass surgery or response to a medication, restenosis after stent implantation, collateral vessel growth due to therapeutic angiogenesis therapy, decreased angina due to revascularization, resolution of symptoms associated with a myriad of therapies, and the like. Alternatively, the disease criteria corresponds with previously identified or classic risk factors and may correspond to prognosis or future disease diagnosis. As indicated above, a disease criterion can also correspond to genotype for one or more loci. Disease criteria (including patient data) may be collected (and compared) from the same patient at different points in time, from different patients, between patients with a disease (criterion) and patients representing a control population, etc. Longitudinal data, i.e., data collected at different time points from an individual (or group of individuals) may be used for comparisons of samples obtained from an individual (group of individuals) at different points in time, to permit identification of differences specifically related to the disease state, and to obtain information relating to the change in expression over time, including a rate of change or trajectory of expression over time. The usefulness of longitudinal data is further discussed in the section titled "Identification of diagnostic nucleotide sets of the invention".

It is further understood that diagnostic nucleotide sets may be developed for use in diagnosing conditions for which there is no present means of diagnosis. For example, in rheumatoid arthritis, joint destruction is often well under way before a patient experience symptoms of the condition. A diagnostic nucleotide set may be developed that diagnoses rheumatic joint destruction at an earlier stage than would be possible using present means of diagnosis, which rely in part on the presentation of symptoms by a patient. Diagnostic nucleotide sets may also be developed to replace or augment current diagnostic procedures. For example, the use of a diagnostic nucleotide set to diagnose cardiac allograft rejection may replace the current diagnostic test, a graft biopsy.

It is understood that the following discussion of diseases is exemplary and non-limiting, and further that the general criteria discussed above, e.g. use of family medical history, are generally applicable to the specific diseases discussed below.

In addition to leukocytes, as described throughout, the general method is applicable to nucleotide sequences that are differentially expressed in any subject tissue or cell type, by the collection and assessment of samples of that tissue or cell type. However, in many cases, collection of such samples presents significant technical or medical problems given the current state of the art.

Organ Transplant Rejection and Success

A frequent complication of organ transplantation is recognition of the transplanted organ as foreign by the immune system resulting in rejection. Diagnostic nucleotide sets can be identified and validated for monitoring organ transplant success, rejection and treatment. Medications currently exist that suppress the immune system, and thereby decrease the rate of and severity of rejection. However, these drugs also suppress the physiologic immune responses, leaving the patient susceptible to a wide variety of opportunistic infections and cancers. At present there is no easy, reliable way to diagnose transplant rejection. Organ biopsy is the preferred method, but this is expensive, painful and associated with significant risk and has inadequate sensitivity for focal rejection.

Diagnostic nucleotide sets of the present invention can be developed and validated for use as diagnostic tests for transplant rejection and success. It is appreciated that the methods of identifying diagnostic nucleotide sets are applicable to any organ transplant population. For example, diagnostic nucleotide sets are developed for cardiac allograft rejection and success.

In some cases, disease criteria correspond to acute stage rejection diagnosis based on organ biopsy and graded using the International Society for Heart and Lung Transplantation ("ISHLT") criteria. This grading system classifies endomyocardial biopsies on the histological level as Grade 0, 1A, 1B, 2, 3A, 3B, or 4. Grade 0 biopsies have no evidence of rejection, while each successive grade has increased severity of leukocyte infiltration and/or damage to the graft myocardial cells. It is appreciated that there is variability in the Grading systems between medical centers and pathologists and between repeated readings of the same pathologist at different times. When using the biopsy grade as a disease criterion for leukocyte gene expression correlation analysis, it may be desirable to have a single pathologist read all biopsy slides or have multiple pathologists read all slides to determine the variability in this disease criterion. It is also appreciated that cardiac biopsy, in part due to variability, is not 100% sensitive or 100% specific for diagnosing acute rejection. When using the cardiac biopsy grade as a disease criterion for the discovery of diagnostic gene sets, it may be desirable to divide patient samples into diagnostic categories based on the grades. Examples of such classes are those patients with: Grade 0 vs. Grades 1A-4, Grade 0 vs. Grades 1B-4, Grade 0 vs. Grades 2-4, Grade 0-1 vs. Grade 2-4, Grade 0-1 vs. Grade 3A-4, or Grade 0 vs. Grade 3A-4.

Other disease criteria correspond to the cardiac biopsy results and other criteria, such as the results of cardiac function testing by echocardiography, hemodynamics assessment by cardiac catheterization, CMV infection, weeks post transplant, medication regimen, demographics and/or results of other diagnostic tests.

Other disease criteria correspond to information from the patient's medical history and information regarding the organ donor. Alternatively, disease criteria include the presence or absence of cytomegalovirus (CMV) infection, Epstein-Barr virus (EBV) infection, allograft dysfunction measured by physiological tests of cardiac function (e.g., hemodynamic measurements from catheterization or echocardiograph data), and symptoms of other infections. Alternatively, disease criteria correspond to therapeutic outcome, e.g. graft failure, re-transplantation, death, hospitalization, need for intravenous immunosuppression, transplant vasculopathy, response to immunosuppressive medications, etc. Disease criteria may further correspond to a rejection episode of at least moderate histologic grade, which results in treatment of the patient with additional corticosteroids, anti-T cell antibodies, or total lymphoid irradiation; a rejection with histologic grade 2 or higher; a rejection with histologic grade <2; the absence of histologic rejection and normal or unchanged allograft function (based on hemodynamic measurements from catheterization or on echocardiographic data); the presence of severe allograft dysfunction or worsening allograft dysfunction during the study period (based on hemodynamic measurements from catheterization or on echocardiographic data); documented CMV infection by culture, histology, or PCR, and at least one clinical sign or symptom of infection; specific graft biopsy rejection grades; rejection of mild to moderate histologic severity prompting augmentation of the patient's chronic immunosuppressive regimen; rejection of mild to moderate severity with allograft dysfunction prompting plasmaphoresis or a diagnosis of "humoral" rejection; infections other than CMV, especially infection with Epstein Barr virus (EBV); lymphoproliferative disorder (also called post-transplant lymphoma); transplant vasculopathy diagnosed by increased intimal thickness on intravascular ultrasound (IVUS), angiography, or acute myocardial infarction; graft failure or retransplantation; and all cause mortality. Further specific examples of clinical data useful as disease criteria are provided in Example 3.

In another example, diagnostic nucleotide sets are developed and validated for use in diagnosis and monitoring of kidney allograft recipients. Disease criteria correspond to, e.g., results of biopsy analysis for kidney allograft rejection, serum creatine level, creatinine clearance, radiological imaging results for the kidney and urinalysis results. Another disease criterion corresponds to the need for hemodialysis, retransplantation, death or other renal replacement therapy.

Diagnostic nucleotide sets are developed and validated for use in diagnosis and treatment of bone marrow transplant and liver transplantation patients, respectively. Disease criteria for bone marrow transplant correspond to the diagnosis and monitoring of graft rejection and/or graft versus host disease, the recurrence of cancer, complications due to immunosuppression, hematologic abnormalities, infection, hospitalization and/or death. Disease criteria for liver transplant rejection include levels of serum markers for liver damage and liver function such as AST (aspartate aminotransferase), ALT (alanine aminotransferase), Alkaline phosphatase, GGT, (gamma-glutamyl transpeptidase) Bilirubin, Albumin and Prothrombin time. Further disease criteria correspond to hepatic encephalopathy, medication usage, ascites, graft failure, retransplantation, hospitalization, complications of immunosuppression, results of diagnostic tests, results of radiological testing, death and histological rejection on graft biopsy. In addition, urine can be utilized for at the target tissue for profiling in renal transplant, while biliary and intestinal secretions and feces may be used favorably for hepatic or intestinal organ allograft rejection. Diagnostic nucleotide sets can also be discovered and developed for the diagnosis and monitoring of chronic renal allograft rejection.

In the case of renal allografts, gene expression markers may be identified that are secreted proteins. These proteins may be detected in the urine of allograft recipients using standard immunoassays. Proteins are more likely to be present in the urine if they are of low molecular weight. Lower molecular weight proteins are more likely to pass through the glomerular membrane and into the urine.

In another example, diagnostic nucleotide sets are developed and validated for use in diagnosis and treatment of xenograft recipients. This can include the transplantation of any organ from a non-human animal to a human or between non-human animals. Considerations for discovery and application of diagnostics and therapeutics and for disease criterion are substantially similar to those for allograft transplantation between humans.

In another example, diagnostic nucleotide sets are developed and validated for use in diagnosis and treatment of artificial organ recipients. This includes, but is not limited to mechanical circulatory support, artificial hearts, left ventricular assist devices, renal replacement therapies, organ prostheses and the like. Disease criteria are thrombosis (blood clots), infection, death, hospitalization, and worsening measures of organ function (e.g., hemodynamics, creatinine, liver function testing, renal function testing, functional capacity).

In another example, diagnostic nucleotide sets are developed and validated for use in matching donor organs to appropriate recipients. Diagnostic gene set can be discovered that correlate with successful matching of donor organ to recipient. Disease criteria include graft failure, acute and chronic rejection, death, hospitalization, immunosuppressive drug use, and complications of immunosuppression. Gene sets may be assayed from the donor or recipient's peripheral blood, organ tissue or some other tissue.

In another example, diagnostic nucleotide sets are developed and validated for use in diagnosis and induction of patient immune tolerance (decrease rejection of an allograft by the host immune system). Disease criteria include rejection, assays of immune activation, need for immunosuppression and all disease criteria noted above for transplantation of each organ.

Viral Diseases

Diagnostic leukocyte nucleotide sets may be developed and validated for use in diagnosing viral disease, as well as diagnosing and monitoring transplant rejection. In another aspect, viral nucleotide sequences may be added to a leukocyte nucleotide set for use in diagnosis of viral diseases, as well as diagnosing and monitoring transplant rejection. Alternatively, viral nucleotide sets and leukocyte nucleotides sets may be used sequentially.

Epstein-Barr Virus (EBV)

EBV causes a variety of diseases such as mononucleosis, B-cell lymphoma, and pharyngeal carcinoma. It infects mononuclear cells and circulating atypical lymphocytes are a common manifestation of infection. Peripheral leukocyte gene expression is altered by infection. Transplant recipients and patients who are immunosuppressed are at increased risk for EBV-associated lymphoma.

Diagnostic nucleotide sets may be developed and validated for use in diagnosis and monitoring of EBV, as well as diagnosing and monitoring transplant rejection. In one aspect, the diagnostic nucleotide set is a leukocyte nucleotide set. Alternatively, EBV nucleotide sequences are added to a leukocyte nucleotide set, for use in diagnosing EBV. Disease criteria correspond with diagnosis of EBV, and, in patients who are EBV-sero-positive, presence (or prospective occurrence) of EBV-related illnesses such as mononucleosis, and EBV-associated lymphoma. Diagnostic nucleotide sets are useful for diagnosis of EBV, and prediction of occurrence of EBV-related illnesses.

Cytomegalovirus (CMV)

Cytomegalovirus cause inflammation and disease in almost any tissue, particularly the colon, lung, bone marrow and retina, and is a very important cause of disease in immunosuppressed patients, e.g. transplant, cancer, AIDS. Many patients are infected with or have been exposed to CMV, but not all patients develop clinical disease from the virus. Also, CMV negative recipients of allografts that come from CMV positive donors are at high risk for CMV infection. As immunosuppressive drugs are developed and used, it is increasingly important to identify patients with current or impending clinical CMV disease, because the potential benefit of immunosuppressive therapy must be balanced with the increased rate of clinical CMV infection and disease that may result from the use of immunosuppression therapy. CMV may also play a role in the occurrence of atherosclerosis or restenosis after angioplasty. CMV expression also correlates to transplant rejection, and is useful in diagnosing and monitoring transplant rejection.

Diagnostic nucleotide sets are developed for use in diagnosis and monitoring of CMV infection or re-activation of CMV infection. In one aspect, the diagnostic nucleotide set is a leukocyte nucleotide set. In another aspect, CMV nucleotide sequences are added to a leukocyte nucleotide set, for use in diagnosing CMV. Disease criteria correspond to diagnosis of CMV (e.g., sero-positive state) and presence of clinically active CMV. Disease criteria may also correspond to prospective data, e.g. the likelihood that CMV will become clinically active or impending clinical CMV infection. Antiviral medications are available and diagnostic nucleotide sets can be used to select patients for early treatment, chronic suppression or prophylaxis of CMV activity.

Hepatitis B and C

These chronic viral infections affect about 1.25 and 2.7 million patients in the US, respectively. Many patients are infected, but suffer no clinical manifestations. Some patients with infection go on to suffer from chronic liver failure, cirrhosis and hepatic carcinoma.

Diagnostic nucleotide sets are developed for use in diagnosis and monitoring of HBV or HCV infection. In one aspect, the diagnostic nucleotide set is a leukocyte nucleotide set. In another aspect, viral nucleotide sequences are added to a leukocyte nucleotide set, for use in diagnosing the virus and monitoring progression of liver disease. Disease criteria correspond to diagnosis of the virus (e.g., sero-positive state or other disease symptoms). Alternatively, disease criteria correspond to liver damage, e.g., elevated alkaline phosphatase, ALT, AST or evidence of ongoing hepatic damage on liver biopsy. Alternatively, disease criteria correspond to serum liver tests (AST, ALT, Alkaline Phosphatase, GGT, PT, bilirubin), liver biopsy, liver ultrasound, viral load by serum PCR, cirrhosis, hepatic cancer, need for hospitalization or listing for liver transplant. Diagnostic nucleotide sets are used to diagnose HBV and HCV, and to predict likelihood of disease progression. Antiviral therapeutic usage, such as Interferon gamma and Ribavirin, can also be disease criteria.

HIV

HIV infects T cells and certainly causes alterations in leukocyte expression. Diagnostic nucleotide sets are developed for diagnosis and monitoring of HIV. In one aspect, the diagnostic nucleotide set is a leukocyte nucleotide set. In another aspect, viral nucleotide sequences are added to a leukocyte nucleotide set, for use in diagnosing the virus. Disease criteria correspond to diagnosis of the virus (e.g., sero-positive state). In addition, disease criteria correspond to viral load, CD4 T cell counts, opportunistic infection, response to antiretroviral therapy, progression to AIDS, rate of progression and the occurrence of other HIV related outcomes (e.g., malignancy, CNS disturbance). Response to antiretrovirals may also be disease criteria.

Pharmacogenomics

Pharmacogenomics is the study of the individual propensity to respond to a particular drug therapy (combination of therapies). In this context, response can mean whether a particular drug will work on a particular patient, e.g. some patients respond to one drug but not to another drug. Response can also refer to the likelihood of successful treatment or the assessment of progress in treatment. Titration of drug therapy to a particular patient is also included in this description, e.g. different patients can respond to different doses of a given medication. This aspect may be important when drugs with side-effects or interactions with other drug therapies are contemplated.

Diagnostic nucleotide sets are developed and validated for use in assessing whether a patient will respond to a particular therapy and/or monitoring response of a patient to drug therapy (therapies). Disease criteria correspond to presence or absence of clinical symptoms or clinical endpoints, presence of side-effects or interaction with other drug(s). The diagnostic nucleotide set may further comprise nucleotide sequences that are targets of drug treatment or markers of active disease.

Validation and Accuracy of Diagnostic Nucleotide Sets

Prior to widespread application of the diagnostic probe sets of the invention the predictive value of the probe set is validated. When the diagnostic probe set is discovered by microarray based expression analysis, the differential expression of the member genes may be validated by a less variable and more quantitative and accurate technology such as real time PCR. In this type of experiment the amplification product is measured during the PCR reaction. This enables the researcher to observe the amplification before any reagent becomes rate limiting for amplification. In kinetic PCR the measurement is of $C_T$ (threshold cycle) or $C_P$ (crossing point). This measurement ($C_T = C_P$) is the point at which an amplification curve crosses a threshold fluorescence value. The threshold is set to a point within the area where all of the reactions were in their linear phase of amplification. When measuring $C_T$, a lower $C_T$ value is indicative of a higher amount of starting material since an earlier cycle number means the threshold was crossed more quickly.

Several fluorescence methodologies are available to measure amplification product in real-time PCR. Taqman (Applied BioSystems, Foster City, Calif.) uses fluorescence resonance energy transfer (FRET) to inhibit signal from a probe until the probe is degraded by the sequence specific binding and Taq 3' exonuclease activity. Molecular Beacons (Stratagene, La Jolla, Calif.) also use FRET technology, whereby the fluorescence is measured when a hairpin structure is relaxed by the specific probe binding to the amplified DNA. The third commonly used chemistry is Sybr Green, a DNA-binding dye (Molecular Probes, Eugene, Oreg.). The more amplified product that is produced, the higher the signal. The Sybr Green method is sensitive to non-specific amplification products, increasing the importance of primer design and selection. Other detection chemistries can also been used, such as ethedium bromide or other DNA-binding dyes and many modifications of the fluorescent dye/quencher dye Taqman chemistry, for example scorpions.

Real-time PCR validation can be done as described in Example 12.

Typically, the oligonucleotide sequence of each probe is confirmed, e.g. by DNA sequencing using an oligonucleotide-specific primer. Partial sequence obtained is generally sufficient to confirm the identity of the oligonucleotide probe. Alternatively, a complementary polynucleotide is fluorescently labeled and hybridized to the array, or to a different array containing a resynthesized version of the oligo nucleotide probe, and detection of the correct probe is confirmed.

Typically, validation is performed by statistically evaluating the accuracy of the correspondence between the molecular signature for a diagnostic probe set and a selected indicator. For example, the expression differential for a nucleotide sequence between two subject classes can be expressed as a simple ratio of relative expression. The expression of the nucleotide sequence in subjects with selected indicator can be compared to the expression of that nucleotide sequence in subjects without the indicator, as described in the following equations.

$$\Sigma E_x ai/N = E_x A$$

the average expression of nucleotide sequence x in the members of group A;

$$\Sigma E_x bi/M = E_x B$$

the average expression of nucleotide sequence x in the members of group B;

$$E_x A/ExB = \Delta E_x AB$$

the average differential expression of nucleotide sequence x between groups A and B:

where $\Sigma$ indicates a sum; Ex is the expression of nucleotide sequence x relative to a standard; ai are the individual members of group A, group A has N members; bi are the individual members of group B, group B has M members.

The expression of at least two nucleotide sequences, e.g., nucleotide sequence X and nucleotide sequence Y are measured relative to a standard in at least one subject of group A (e.g., with a disease) and group B (e.g., without the disease). Ideally, for purposes of validation the indicator is independent from (i.e., not assigned based upon) the expression pattern. Alternatively, a minimum threshold of gene expression for nucleotide sequences X and Y, relative to the standard, are designated for assignment to group A. For nucleotide sequence x, this threshold is designated $\Delta$Ex, and for nucleotide sequence y, the threshold is designated $\Delta$Ey.

The following formulas are used in the calculations below:

Sensitivity=(true positives/true positives+false negatives)

Specificity=(true negatives/true negatives+false positives)

If, for example, expression of nucleotide sequence x above a threshold: x>$\Delta$Ex, is observed for 80/100 subjects in group A and for 10/100 subjects in group B, the sensitivity of nucleotide sequence x for the assignment to group A, at the given expression threshold $\Delta$Ex, is 80%, and the specificity is 90%.

If the expression of nucleotide sequence y is >$\Delta$Ey in 80/100 subjects in group A, and in 10/100 subjects in group B, then, similarly the sensitivity of nucleotide sequence y for the assignment to group A at the given threshold $\Delta$Ey is 80% and the specificity is 90%. If in addition, 60 of the 80 subjects in group A that meet the expression threshold for nucleotide sequence y also meet the expression threshold $\Delta$Ex and that 5 of the 10 subjects in group B that meet the expression threshold for nucleotide sequence y also meet the expression threshold $\Delta$Ex, the sensitivity of the test (x>$\Delta$Ex and y>$\Delta$Ey) for assignment of subjects to group A is 60% and the specificity is 95%.

Alternatively, if the criteria for assignment to group A are change to: Expression of x>$\Delta$Ex or expression of y>$\Delta$Ey, the sensitivity approaches 100% and the specificity is 85%.

Clearly, the predictive accuracy of any diagnostic probe set is dependent on the minimum expression threshold selected. The expression of nucleotide sequence X (relative to a standard) is measured in subjects of groups A (with disease) and B (without disease). The minimum threshold of nucleotide sequence expression for x, required for assignment to group A is designated $\Delta$Ex 1.

If 90/100 patients in group A have expression of nucleotide sequence x>$\Delta$Ex 1 and 20/100 patients in group B have expression of nucleotide sequence x>$\Delta$Ex 1, then the sensitivity of the expression of nucleotide sequence x (using $\Delta$Ex 1 as a minimum expression threshold) for assignment of patients to group A will be 90% and the specificity will be 80%.

Altering the minimum expression threshold results in an alteration in the specificity and sensitivity of the nucleotide sequences in question. For example, if the minimum expression threshold of nucleotide sequence x for assignment of subjects to group A is lowered to $\Delta$Ex 2, such that 100/100 subjects in group A and 40/100 subjects in group B meet the threshold, then the sensitivity of the test for assignment of subjects to group A will be 100% and the specificity will be 60%.

Thus, for 2 nucleotide sequences X and Y: the expression of nucleotide sequence x and nucleotide sequence y (relative to a standard) are measured in subjects belonging to groups A (with disease) and B (without disease). Minimum thresholds of nucleotide sequence expression for nucleotide sequences X and Y (relative to common standards) are designated for assignment to group A. For nucleotide sequence x, this threshold is designated $\Delta$Ex1 and for nucleotide sequence y, this threshold is designated $\Delta$Ey1.

If in group A, 90/100 patients meet the minimum requirements of expression $\Delta$Ex1 and $\Delta$Ey1, and in group B, 10/100 subjects meet the minimum requirements of expression $\Delta$Ex1 and $\Delta$Ey1, then the sensitivity of the test for assignment of subjects to group A is 90% and the specificity is 90%.

Increasing the minimum expression thresholds for X and Y to ΔEx2 and ΔEy2, such that in group A, 70/100 subjects meet the minimum requirements of expression ΔEx2 and ΔEy2, and in group B, 3/100 subjects meet the minimum requirements of expression ΔEx2 and ΔEy2. Now the sensitivity of the test for assignment of subjects to group A is 70% and the specificity is 97%.

If the criteria for assignment to group A is that the subject in question meets either threshold, ΔEx2 or ΔEy2, and it is found that 100/100 subjects in group A meet the criteria and 20/100 subjects in group B meet the criteria, then the sensitivity of the test for assignment to group A is 100% and the specificity is 80%.

Individual components of a diagnostic probe set each have a defined sensitivity and specificity for distinguishing between subject groups. Such individual nucleotide sequences can be employed in concert as a diagnostic probe set to increase the sensitivity and specificity of the evaluation. The database of molecular signatures is queried by algorithms to identify the set of nucleotide sequences (i.e., corresponding to members of the probe set) with the highest average differential expression between subject groups. Typically, as the number of nucleotide sequences in the diagnostic probe set increases, so does the predictive value, that is, the sensitivity and specificity of the probe set. When the probe sets are defined they may be used for diagnosis and patient monitoring as discussed below. The diagnostic sensitivity and specificity of the probe sets for the defined use can be determined for a given probe set with specified expression levels as demonstrated above. By altering the expression threshold required for the use of each nucleotide sequence as a diagnostic, the sensitivity and specificity of the probe set can be altered by the practitioner. For example, by lowering the magnitude of the expression differential threshold for each nucleotide sequence in the set, the sensitivity of the test will increase, but the specificity will decrease. As is apparent from the foregoing discussion, sensitivity and specificity are inversely related and the predictive accuracy of the probe set is continuous and dependent on the expression threshold set for each nucleotide sequence. Although sensitivity and specificity tend to have an inverse relationship when expression thresholds are altered, both parameters can be increased as nucleotide sequences with predictive value are added to the diagnostic nucleotide set. In addition a single or a few markers may not be reliable expression markers across a population of patients. This is because of the variability in expression and measurement of expression that exists between measurements, individuals and individuals over time. Inclusion of a large number of candidate nucleotide sequences or large numbers of nucleotide sequences in a diagnostic nucleotide set allows for this variability as not all nucleotide sequences need to meet a threshold for diagnosis. Generally, more markers are better than a single marker. If many markers are used to make a diagnosis, the likelihood that all expression markers will not meet some thresholds based upon random variability is low and thus the test will give fewer false negatives.

It is appreciated that the desired diagnostic sensitivity and specificity of the diagnostic nucleotide set may vary depending on the intended use of the set. For example, in certain uses, high specificity and high sensitivity are desired. For example, a diagnostic nucleotide set for predicting which patient population may experience side effects may require high sensitivity so as to avoid treating such patients. In other settings, high sensitivity is desired, while reduced specificity may be tolerated. For example, in the case of a beneficial treatment with few side effects, it may be important to identify as many patients as possible (high sensitivity) who will respond to the drug, and treatment of some patients who will not respond is tolerated. In other settings, high specificity is desired and reduced sensitivity may be tolerated. For example, when identifying patients for an early-phase clinical trial, it is important to identify patients who may respond to the particular treatment. Lower sensitivity is tolerated in this setting as it merely results in reduced patients who enroll in the study or requires that more patients are screened for enrollment.

Methods of Using Diagnostic Nucleotide Sets.

The invention also provide methods of using the diagnostic nucleotide sets to: diagnose disease; assess severity of disease; predict future occurrence of disease; predict future complications of disease; determine disease prognosis; evaluate the patient's risk, or "stratify" a group of patients; assess response to current drug therapy; assess response to current non-pharmacological therapy; determine the most appropriate medication or treatment for the patient; predict whether a patient is likely to respond to a particular drug; and determine most appropriate additional diagnostic testing for the patient, among other clinically and epidemiologically relevant applications.

The nucleotide sets of the invention can be utilized for a variety of purposes by physicians, healthcare workers, hospitals, laboratories, patients, companies and other institutions. As indicated previously, essentially any disease, condition, or status for which at least one nucleotide sequence is differentially expressed in leukocyte populations (or sub-populations) can be evaluated, e.g., diagnosed, monitored, etc. using the diagnostic nucleotide sets and methods of the invention. In addition to assessing health status at an individual level, the diagnostic nucleotide sets of the present invention are suitable for evaluating subjects at a "population level," e.g., for epidemiological studies, or for population screening for a condition or disease.

Collection and Preparation of Sample

RNA, protein and/or DNA is prepared using methods well-known in the art, as further described herein. It is appreciated that subject samples collected for use in the methods of the invention are generally collected in a clinical setting, where delays may be introduced before RNA samples are prepared from the subject samples of whole blood, e.g. the blood sample may not be promptly delivered to the clinical lab for further processing. Further delay may be introduced in the clinical lab setting where multiple samples are generally being processed at any given time. For this reason, methods which feature lengthy incubations of intact leukocytes at room temperature are not preferred, because the expression profile of the leukocytes may change during this extended time period. For example, RNA can be isolated from whole blood using a phenol/guanidine isothiocyanate reagent or another direct whole-blood lysis method, as described in, e.g., U.S. Pat. Nos. 5,346,994 and 4,843,155. This method may be less preferred under certain circumstances because the large majority of the RNA recovered from whole blood RNA extraction comes from erythrocytes since these cells outnumber leukocytes 1000:1. Care must be taken to ensure that the presence of erythrocyte RNA and protein does not introduce bias in the RNA expression profile data or lead to inadequate sensitivity or specificity of probes.

Alternatively, intact leukocytes may be collected from whole blood using a lysis buffer that selectively lyses erythrocytes, but not leukocytes, as described, e.g., in (U.S. Pat. Nos. 5,973,137, and 6,020,186). Intact leukocytes are then collected by centrifugation, and leukocyte RNA is isolated using standard protocols, as described herein. However, this method does not allow isolation of sub-populations of leukocytes, e.g. mononuclear cells, which may be desired. In addition, the expression profile may change during the lengthy incubation in lysis buffer, especially in a busy clinical lab where large numbers of samples are being prepared at any given time.

Alternatively, specific leukocyte cell types can be separated using density gradient reagents (Boyum, A, 1968.). For example, mononuclear cells may be separated from whole blood using density gradient centrifugation, as described, e.g., in U.S. Pat. Nos. 4,190,535, 4,350,593, 4,751,001, 4,818,418, and 5,053,134. Blood is drawn directly into a tube containing an anticoagulant and a density reagent (such as Ficoll or Percoll). Centrifugation of this tube results in separation of blood into an erythrocyte and granulocyte layer, a mononuclear cell suspension, and a plasma layer. The mononuclear cell layer is easily removed and the cells can be collected by centrifugation, lysed, and frozen. Frozen samples are stable until RNA can be isolated. Density centrifugation, however, must be conducted at room temperature, and if processing is unduly lengthy, such as in a busy clinical lab, the expression profile may change.

Alternatively, cells can be separated using fluorescence activated cell sorting (FACS) or some other technique, which divides cells into subsets based on gene or protein expression. This may be desirable to enrich the sample for cells of interest, but it may also introduce cell manipulations and time delays, which result in alteration of gene expression profiles (Cantor et al. 1975; Galbraith et al. 1999).

The quality and quantity of each clinical RNA sample is desirably checked before amplification and labeling for array hybridization, using methods known in the art. For example, one microliter of each sample may be analyzed on a Bioanalyzer (Agilent 2100 Palo Alto, Calif. USA) using an RNA 6000 nano LabChip (Caliper, Mountain View, Calif. USA). Degraded RNA is identified by the reduction of the 28S to 18S ribosomal RNA ratio and/or the presence of large quantities of RNA in the 25-100 nucleotide range.

It is appreciated that the RNA sample for use with a diagnostic nucleotide set may be produced from the same or a different cell population, sub-population and/or cell type as used to identify the diagnostic nucleotide set. For example, a diagnostic nucleotide set identified using RNA extracted from mononuclear cells may be suitable for analysis of RNA extracted from whole blood or mononuclear cells, depending on the particular characteristics of the members of the diagnostic nucleotide set. Generally, diagnostic nucleotide sets must be tested and validated when used with RNA derived from a different cell population, sub-population or cell type than that used when obtaining the diagnostic gene set. Factors such as the cell-specific gene expression of diagnostic nucleotide set members, redundancy of the information provided by members of the diagnostic nucleotide set, expression level of the member of the diagnostic nucleotide set, and cell-specific alteration of expression of a member of the diagnostic nucleotide set will contribute to the usefulness of using a different RNA source than that used when identifying the members of the diagnostic nucleotide set. It is appreciated that it may be desirable to assay RNA derived from whole blood, obviating the need to isolate particular cell types from the blood.

Rapid Method of RNA Extraction Suitable for Production in a Clinical Setting of High Quality RNA for Expression Profiling In a clinical setting, obtaining high quality RNA preparations suitable for expression profiling, from a desired population of leukocytes poses certain technical challenges, including: the lack of capacity for rapid, high-throughput sample processing in the clinical setting, and the possibility that delay in processing (in a busy lab or in the clinical setting) may adversely affect RNA quality, e.g. by a permitting the expression profile of certain nucleotide sequences to shift. Also, use of toxic and expensive reagents, such as phenol, may be disfavored in the clinical setting due to the added expense associated with shipping and handling such reagents.

A useful method for RNA isolation for leukocyte expression profiling would allow the isolation of monocyte and lymphocyte RNA in a timely manner, while preserving the expression profiles of the cells, and allowing inexpensive production of reproducible high-quality RNA samples. Accordingly, the invention provides a method of adding inhibitor(s) of RNA transcription and/or inhibitor(s) of protein synthesis, such that the expression profile is "frozen" and RNA degradation is reduced. A desired leukocyte population or sub-population is then isolated, and the sample may be frozen or lysed before further processing to extract the RNA. Blood is drawn from subject population and exposed to ActinomycinD (to a final concentration of 10 ug/ml) to inhibit transcription, and cycloheximide (to a final concentration of 10 ug/ml) to inhibit protein synthesis. The inhibitor(s) can be injected into the blood collection tube in liquid form as soon as the blood is drawn, or the tube can be manufactured to contain either lyophilized inhibitors or inhibitors that are in solution with the anticoagulant. At this point, the blood sample can be stored at room temperature until the desired leukocyte population or sub-population is isolated, as described elsewhere. RNA is isolated using standard methods, e.g., as described above, or a cell pellet or extract can be frozen until further processing of RNA is convenient.

The invention also provides a method of using a low-temperature density gradient for separation of a desired leukocyte sample. In another embodiment, the invention provides the combination of use of a low-temperature density gradient and the use of transcriptional and/or protein synthesis inhibitor(s). A desired leukocyte population is separated using a density gradient solution for cell separation that maintains the required density and viscosity for cell separation at 0-4° C. Blood is drawn into a tube containing this solution and may be refrigerated before and during processing as the low temperatures slow cellular processes and minimize expression profile changes. Leukocytes are separated, and RNA is isolated using standard methods. Alternately, a cell pellet or extract is frozen until further processing of RNA is convenient. Care must be taken to avoid rewarming the sample during further processing steps.

Alternatively, the invention provides a method of using low-temperature density gradient separation, combined with the use of actinomycin A and cyclohexamide, as described above.

Assessing Expression for Diagnostics

Expression profiles for the set of diagnostic nucleotide sequences in a subject sample can be evaluated by any technique that determines the expression of each component nucleotide sequence. Methods suitable for expression analysis are known in the art, and numerous examples are discussed in the Sections titled "Methods of obtaining expression data" and "high throughput expression Assays", above.

In many cases, evaluation of expression profiles is most efficiently, and cost effectively, performed by analyzing RNA expression. Alternatively, the proteins encoded by each component of the diagnostic nucleotide set are detected for diagnostic purposes by any technique capable of determining protein expression, e.g., as described above. Expression profiles can be assessed in subject leukocyte sample using the same or different techniques as those used to identify and validate the diagnostic nucleotide set. For example, a diagnostic nucleotide set identified as a subset of sequences on a cDNA microarray can be utilized for diagnostic (or prognostic, or monitoring, etc.) purposes on the same array from which they were identified. Alternatively, the diagnostic nucleotide sets for a given disease or condition can be organized onto a dedicated sub-array for the indicated purpose. It is important to note that if diagnostic nucleotide sets are discovered using one technology, e.g. RNA expression profiling, but applied as a diagnostic using another technology, e.g. protein expression profiling, the nucleotide sets must generally be validated for diagnostic purposes with the new technology. In addition, it is appreciated that diagnostic nucleotide sets that are developed for one use, e.g. to diagnose a particular disease, may later be found to be useful for a different application, e.g. to predict the likelihood that the particular disease will occur. Generally, the diagnostic nucleotide set will need to be validated for use in the second circumstance. As discussed herein, the sequence of diagnostic nucleotide set members may be amplified from RNA or cDNA using methods known in the art providing specific amplification of the nucleotide sequences.

General Protein Methods

Protein products of the nucleotide sequences of the invention may include proteins that represent functionally equivalent gene products. Such an equivalent gene product may contain deletions, additions or substitutions of amino acid residues within the amino acid sequence encoded by the nucleotide sequences described, above, but which result in a silent change, thus producing a functionally equivalent nucleotide sequence product. Amino acid substitutions may be made on the basis of similarity in polarity, charge, solubility, hydrophobicity, hydrophilicity, and/or the amphipathic nature of the residues involved.

For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. "Functionally equivalent", as utilized herein, refers to a protein capable of exhibiting a substantially similar in vivo activity as the endogenous gene products encoded by the nucleotide described, above.

The gene products (protein products of the nucleotide sequences) may be produced by recombinant DNA technology using techniques well known in the art. Thus, methods for preparing the gene polypeptides and peptides of the invention by expressing nucleic acid encoding nucleotide sequences are described herein. Methods which are well known to those skilled in the art can be used to construct expression vectors containing nucleotide sequence protein coding sequences and appropriate transcriptional/translational control signals. These methods include, for example, in vitro recombinant DNA techniques, synthetic techniques and in vivo recombination/genetic recombination. See, for example, the techniques described in Sambrook et al., 1989, supra, and Ausubel et al., 1989, supra. Alternatively, RNA capable of encoding nucleotide sequence protein sequences may be chemically synthesized using, for example, synthesizers. See, for example, the techniques described in "Oligonucleotide Synthesis", 1984, Gait, M. J. ed., IRL Press, Oxford, which is incorporated by reference herein in its entirety A variety of host-expression vector systems may be utilized to express the nucleotide sequence coding sequences of the invention. Such host-expression systems represent vehicles by which the coding sequences of interest may be produced and subsequently purified, but also represent cells which may, when transformed or transfected with the appropriate nucleotide coding sequences, exhibit the protein encoded by the nucleotide sequence of the invention in situ. These include but are not limited to microorganisms such as bacteria (e.g., *E. coli, B. subtilis*) transformed with recombinant bacteriophage DNA, plasmid DNA or cosmid DNA expression vectors containing nucleotide sequence protein coding sequences; yeast (e.g. *Saccharomyces, Pichia*) transformed with recombinant yeast expression vectors containing the nucleotide sequence protein coding sequences; insect cell systems infected with recombinant virus expression vectors (e.g., baculovirus) containing the nucleotide sequence protein coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing nucleotide sequence protein coding sequences; or mammalian cell systems (e.g. COS, CHO, BHK, 293, 3T3) harboring recombinant expression constructs containing promoters derived from the genome of mammalian cells (e.g., metallothionein promoter) or from mammalian viruses (e.g., the adenovirus late promoter; the vaccinia virus 7.5 K promoter).

In bacterial systems, a number of expression vectors may be advantageously selected depending upon the use intended for the nucleotide sequence protein being expressed. For example, when a large quantity of such a protein is to be produced, for the generation of antibodies or to screen peptide libraries, for example, vectors which direct the expression of high levels of fusion protein products that are readily purified may be desirable. Such vectors include, but are not limited to, the *E. coli* expression vector pUR278 (Ruther et al., 1983, EMBO J. 2:1791), in which the nucleotide sequence protein coding sequence may be ligated individually into the vector in frame with the lac Z coding region so that a fusion protein is produced; pIN vectors (Inouye & Inouye, 1985, Nucleic Acids Res. 13:3101-3109; Van Heeke & Schuster, 1989, J. Biol. Chem. 264:5503-5509); and the likes of pGEX vectors may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. The pGEX vectors are designed to include thrombin or factor Xa protease cleavage sites so that the cloned target nucleotide sequence protein can be released from the GST moiety. Other systems useful in the invention include use of the FLAG epitope or the 6-HIS systems.

In an insect system, Autographa californica nuclear polyhedrosis virus (AcNPV) is used as a vector to express foreign nucleotide sequences. The virus grows in *Spodoptera frugiperda* cells. The nucleotide sequence coding sequence may be cloned individually into non-essential regions (for example the polyhedrin gene) of the virus and placed under control of an AcNPV promoter (for example the polyhedrin promoter). Successful insertion of nucleotide sequence coding sequence will result in inactivation of the polyhedrin gene and production of non-occluded recombinant virus (i.e., virus lacking the proteinaceous coat coded for by the polyhedrin gene). These recombinant viruses are then used to infect *Spodoptera frugiperda* cells in which the inserted nucleotide sequence is expressed. (E.g., see Smith et al., 1983, J. Virol. 46: 584; Smith, U.S. Pat. No. 4,215,051).

In mammalian host cells, a number of viral-based expression systems may be utilized. In cases where an adenovirus is used as an expression vector, the nucleotide sequence coding sequence of interest may be ligated to an adenovirus transcription/translation control complex, e.g., the late promoter and tripartite leader sequence. This chimeric nucleotide sequence may then be inserted in the adenovirus genome by in vitro or in vivo recombination. Insertion in a non-essential region of the viral genome (e.g., region E1 or E3) will result in a recombinant virus that is viable and capable of expressing nucleotide sequence encoded protein in infected hosts. (E.g., See Logan & Shenk, 1984, Proc. Natl. Acad. Sci. USA 81:3655-3659). Specific initiation signals may also be required for efficient translation of inserted nucleotide sequence coding sequences. These signals include the ATG initiation codon and adjacent sequences. In cases where an entire nucleotide sequence, including its own initiation codon and adjacent sequences, is inserted into the appropriate expression vector, no additional translational control signals may be needed. However, in cases where only a portion of the nucleotide sequence coding sequence is inserted, exogenous translational control signals, including, perhaps, the ATG initiation codon, must be provided. Furthermore, the initiation codon must be in phase with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements, transcription terminators, etc. (see Bittner et al., 1987, Methods in Enzymol. 153:516-544).

In addition, a host cell strain may be chosen which modulates the expression of the inserted sequences, or modifies and processes the product of the nucleotide sequence in the specific fashion desired. Such modifications (e.g., glycosylation) and processing (e.g., cleavage) of protein products may be important for the function of the protein. Different host cells have characteristic and specific mechanisms for the post-translational processing and modification of proteins. Appropriate cell lines or host systems can be chosen to ensure the correct modification and processing of the foreign protein expressed. To this end, eukaryotic host cells which possess the cellular machinery for proper processing of the primary transcript, glycosylation, and phosphorylation of the gene product may be used. Such mammalian host cells include but are not limited to CHO, VERO, BHK, HeLa, COS, MDCK, 293, 3T3, WI38, etc.

For long-term, high-yield production of recombinant proteins, stable expression is preferred. For example, cell lines which stably express the nucleotide sequence encoded protein may be engineered. Rather than using expression vectors which contain viral origins of replication, host cells can be transformed with DNA controlled by appropriate expression control elements (e.g., promoter, enhancer, sequences, transcription terminators, polyadenylation sites, etc.), and a selectable marker. Following the introduction of the foreign DNA, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express nucleotide sequence encoded protein. Such engineered cell lines may be particularly useful in screening and evaluation of compounds that affect the endogenous activity of the nucleotide sequence encoded protein.

A number of selection systems may be used, including but not limited to the herpes simplex virus thymidine kinase (Wigler, et al., 1977, Cell 11:223), hypoxanthine-guanine phosphoribosyltransferase (Szybalska & Szybalski, 1962, Proc. Natl. Acad. Sci. USA 48:2026), and adenine phosphoribosyltransferase (Lowy, et al., 1980, Cell 22:817) genes can be employed in tk-, hgprt- or aprt-cells, respectively. Also, antimetabolite resistance can be used as the basis of selection for dhfr, which confers resistance to methotrexate (Wigler, et al., 1980, Natl. Acad. Sci. USA 77:3567; O'Hare, et al., 1981, Proc. Natl. Acad. Sci. USA 78:1527); gpt, which confers resistance to mycophenolic acid (Mulligan & Berg, 1981, Proc. Natl. Acad. Sci. USA 78:2072); neo, which confers resistance to the aminoglycoside G-418 (Colberre-Garapin, et al., 1981, J. Mol. Biol. 150:1); and hygro, which confers resistance to hygromycin (Santerre, et al., 1984, Gene 30:147) genes.

An alternative fusion protein system allows for the ready purification of non-denatured fusion proteins expressed in human cell lines (Janknecht, et al., 1991, Proc. Natl. Acad. Sci. USA 88: 8972-8976). In this system, the nucleotide sequence of interest is subcloned into a vaccinia recombination plasmid such that the nucleotide sequence's open reading frame is translationally fused to an amino-terminal tag consisting of six histidine residues. Extracts from cells infected with recombinant vaccinia virus are loaded onto Ni.sup.2+− nitriloacetic acid-agarose columns and histidine-tagged proteins are selectively eluted with imidazole-containing buffers.

Where recombinant DNA technology is used to produce the protein encoded by the nucleotide sequence for such assay systems, it may be advantageous to engineer fusion proteins that can facilitate labeling, immobilization and/or detection.

Antibodies

Indirect labeling involves the use of a protein, such as a labeled antibody, which specifically binds to the protein encoded by the nucleotide sequence. Such antibodies include but are not limited to polyclonal, monoclonal, chimeric, single chain, Fab fragments and fragments produced by an Fab expression library.

The invention also provides for antibodies to the protein encoded by the nucleotide sequences. Described herein are methods for the production of antibodies capable of specifically recognizing one or more nucleotide sequence epitopes. Such antibodies may include, but are not limited to polyclonal antibodies, monoclonal antibodies (mAbs), humanized or chimeric antibodies, single chain antibodies, Fab fragments, F(ab')2 fragments, fragments produced by a Fab expression library, anti-idiotypic (anti-Id) antibodies, and epitope-binding fragments of any of the above. Such antibodies may be used, for example, in the detection of a nucleotide sequence in a biological sample, or, alternatively, as a method for the inhibition of abnormal gene activity, for example, the inhibition of a disease target nucleotide sequence, as further described below. Thus, such antibodies may be utilized as part of cardiovascular or other disease treatment method, and/or may be used as part of diagnostic techniques whereby patients may be tested for abnormal levels of nucleotide sequence encoded proteins, or for the presence of abnormal forms of the such proteins.

For the production of antibodies to a nucleotide sequence, various host animals may be immunized by injection with a protein encoded by the nucleotide sequence, or a portion thereof. Such host animals may include but are not limited to rabbits, mice, and rats, to name but a few. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (bacille Calmette-Guerin) and *Corynebacterium parvum*.

Polyclonal antibodies are heterogeneous populations of antibody molecules derived from the sera of animals immunized with an antigen, such as gene product, or an antigenic functional derivative thereof. For the production of polyclonal antibodies, host animals such as those described above, may be immunized by injection with gene product supplemented with adjuvants as also described above.

Monoclonal antibodies, which are homogeneous populations of antibodies to a particular antigen, may be obtained by any technique which provides for the production of antibody molecules by continuous cell lines in culture. These include, but are not limited to the hybridoma technique of Kohler and Milstein, (1975, Nature 256:495-497; and U.S. Pat. No. 4,376,110), the human B-cell hybridoma technique (Kosbor et al., 1983, Immunology Today 4:72; Cole et al., 1983, Proc. Natl. Acad. Sci. USA 80:2026-2030), and the EBV-hybridoma technique (Cole et al., 1985, Monoclonal Antibodies And Cancer Therapy, Alan R. Liss, Inc., pp. 77-96). Such antibodies may be of any immunoglobulin class including IgG, IgM, IgE, IgA, IgD and any subclass thereof. The hybridoma producing the mAb of this invention may be cultivated in vitro or in vivo.

In addition, techniques developed for the production of "chimeric antibodies" (Morrison et al., 1984, Proc. Natl. Acad. Sci., 81:6851-6855; Neuberger et al., 1984, Nature, 312:604-608; Takeda et al., 1985, Nature, 314:452-454) by splicing the genes from a mouse antibody molecule of appropriate antigen specificity together with genes from a human antibody molecule of appropriate biological activity can be used. A chimeric antibody is a molecule in which different portions are derived from different animal species, such as those having a variable region derived from a murine mAb and a human immunoglobulin constant region.

Alternatively, techniques described for the production of single chain antibodies (U.S. Pat. No. 4,946,778; Bird, 1988, Science 242:423-426; Huston et al., 1988, Proc. Natl. Acad. Sci. USA 85:5879-5883; and Ward et al., 1989, Nature 334: 544-546) can be adapted to produce nucleotide sequence-single chain antibodies. Single chain antibodies are formed by linking the heavy and light chain fragments of the Fv region via an amino acid bridge, resulting in a single chain polypeptide.

Antibody fragments which recognize specific epitopes may be generated by known techniques For example, such fragments include but are not limited to: the F(ab')2 fragments which can be produced by pepsin digestion of the antibody molecule and the Fab fragments which can be generated by reducing the disulfide bridges of the F(ab')2 fragments. Alternatively, Fab expression libraries may be constructed (Huse et al., 1989, Science, 246:1275-1281) to allow rapid and easy identification of monoclonal Fab fragments with the desired specificity.

Disease Specific Target Nucleotide Sequences

The invention also provides disease specific target nucleotide sequences, and sets of disease specific target nucleotide sequences. The diagnostic nucleotide sets, subsets thereof, novel nucleotide sequences, and individual members of the diagnostic nucleotide sets identified as described above are also disease specific target nucleotide sequences. In particular, individual nucleotide sequences that are differentially regulated or have predictive value that is strongly correlated with a disease or disease criterion are especially favorable as disease specific target nucleotide sequences. Sets of genes that are co-regulated may also be identified as disease specific target nucleotide sets. Such nucleotide sequences and/or nucleotide sequence products are targets for modulation by a variety of agents and techniques. For example, disease specific target nucleotide sequences (or the products of such nucleotide sequences, or sets of disease specific target nucleotide sequences) can be inhibited or activated by, e.g., target specific monoclonal antibodies or small molecule inhibitors, or delivery of the nucleotide sequence or gene product of the nucleotide sequence to patients. Also, sets of genes can be inhibited or activated by a variety of agents and techniques. The specific usefulness of the target nucleotide sequence(s) depends on the subject groups from which they were discovered, and the disease or disease criterion with which they correlate.

Imaging

The invention also provides for imaging reagents. The differentially expressed leukocyte nucleotide sequences, diagnostic nucleotide sets, or portions thereof, and novel nucleotide sequences of the invention are nucleotide sequences expressed in cells with or without disease. Leukocytes expressing a nucleotide sequence(s) that is differentially expressed in a disease condition may localize within the body to sites that are of interest for imaging purposes. For example, a leukocyte expressing a nucleotide sequence(s) that are differentially expressed in an individual having atherosclerosis may localize or accumulate at the site of an atherosclerotic plaque. Such leukocytes, when labeled, may provide a detection reagent for use in imaging regions of the body where labeled leukocyte accumulate or localize, for example, at the atherosclerotic plaque in the case of atherosclerosis. For example, leukocytes are collected from a subject, labeled in vitro, and reintroduced into a subject. Alternatively, the labeled reagent is introduced into the subject individual, and leukocyte labeling occurs within the patient.

Imaging agents that detect the imaging targets of the invention are produced by well-known molecular and immunological methods (for exemplary protocols, see, e.g., Ausubel, Berger, and Sambrook, as well as Harlow and Lane, supra).

For example, a full-length nucleic acid sequence, or alternatively, a gene fragment encoding an immunogenic peptide or polypeptide fragments, is cloned into a convenient expression vector, for example, a vector including an in-frame epitope or substrate binding tag to facilitate subsequent purification. Protein is then expressed from the cloned cDNA sequence and used to generate antibodies, or other specific binding molecules, to one or more antigens of the imaging target protein. Alternatively, a natural or synthetic polypeptide (or peptide) or small molecule that specifically binds (or is specifically bound to) the expressed imaging target can be identified through well established techniques (see, e.g., Mendel et al. (2006) Anticancer Drug Des 15:29-41; Wilson (2000) Curr Med Chem 7:73-98; Hamby and Showwalter (1999) Pharmacol Ther 82:169-93; and Shimazawa et al. (1998) Curr Opin Struct Biol 8:451-8). The binding molecule, e.g., antibody, small molecule ligand, etc., is labeled with a contrast agent or other detectable label, e.g., gadolinium, iodine, or a gamma-emitting source. For in-vivo imaging of a disease process that involved leukocytes, the labeled antibody is infused into a subject, e.g., a human patient or animal subject, and a sufficient period of time is passed to permit binding of the antibody to target cells. The subject is then imaged with appropriate technology such as MRI (when the label is gadolinium) or with a gamma counter (when the label is a gamma emitter).

Identification of Nucleotide Sequence Involved in Leukocyte Adhesion

The invention also encompasses a method of identifying nucleotide sequences involved in leukocyte adhesion. The interaction between the endothelial cell and leukocyte is a fundamental mechanism of all inflammatory disorders, including the diagnosis and prognosis of allograft rejection the diseases listed in Table 1. For example, the first visible abnormality in atherosclerosis is the adhesion to the endothelium and diapedesis of mononuclear cells (e.g., T-cell and monocyte). Insults to the endothelium (for example, cytokines, tobacco, diabetes, hypertension and many more) lead to endothelial cell activation. The endothelium then expresses adhesion molecules, which have counter receptors on mononuclear cells. Once the leukocyte receptors have bound the endothelial adhesion molecules, they stick to the endothelium, roll a short distance, stop and transmigrate across the endothelium. A similar set of events occurs in both acute and chronic inflammation. When the leukocyte binds the endothelial adhesion molecule, or to soluble cytokines secreted by endothelial or other cells, a program of gene expression is activated in the leukocyte. This program of expression leads to leukocyte rolling, firm adhesion and transmigration into the vessel wall or tissue parenchyma. Inhibition of this process is highly desirable goal in anti-inflammatory drug development. In addition, leukocyte nucleotide sequences and epithelial cell nucleotide sequences, that are differentially expressed during this process may be disease-specific target nucleotide sequences.

Human endothelial cells, e.g. derived from human coronary arteries, human aorta, human pulmonary artery, human umbilical vein or microvascular endothelial cells, are cultured as a confluent monolayer, using standard methods. Some of the endothelial cells are then exposed to cytokines or another activating stimuli such as oxidized LDL, hyperglycemia, shear stress, or hypoxia (Moser et al. 1992). Some endothelial cells are not exposed to such stimuli and serve as controls. For example, the endothelial cell monolayer is incubated with culture medium containing 5 U/ml of human recombinant IL-1alpha or 10 ng/ml TNF (tumor necrosis factor), for a period of minutes to overnight. The culture medium composition is changed or the flask is sealed to induce hypoxia. In addition, tissue culture plate is rotated to induce sheer stress.

Human T-cells and/or monocytes are cultured in tissue culture flasks or plates, with LGM-3 media from Clonetics. Cells are incubated at 37 degree C., 5% CO2 and 95% humidity. These leukocytes are exposed to the activated or control endothelial layer by adding a suspension of leukocytes on to the endothelial cell monolayer. The endothelial cell monolayer is cultured on a tissue culture treated plate/flask or on a microporous membrane. After a variable duration of exposures, the endothelial cells and leukocytes are harvested separately by treating all cells with trypsin and then sorting the endothelial cells from the leukocytes by magnetic affinity reagents to an endothelial cell specific marker such as PECAM-1 (Stem Cell Technologies). RNA is extracted from the isolated cells by standard techniques. Leukocyte RNA is labeled as described above, and hybridized to leukocyte candidate nucleotide library. Epithelial cell RNA is also labeled and hybridized to the leukocyte candidate nucleotide library. Alternatively, the epithelial cell RNA is hybridized to a epithelial cell candidate nucleotide library, prepared according to the methods described for leukocyte candidate libraries, above.

Hybridization to candidate nucleotide libraries will reveal nucleotide sequences that are up-regulated or down-regulated in leukocyte and/or epithelial cells undergoing adhesion. The differentially regulated nucleotide sequences are further characterized, e.g. by isolating and sequencing the full-length sequence, analysis of the DNA and predicted protein sequence, and functional characterization of the protein product of the nucleotide sequence, as described above. Further characterization may result in the identification of leukocyte adhesion specific target nucleotide sequences, which may be candidate targets for regulation of the inflammatory process. Small molecule or antibody inhibitors can be developed to inhibit the target nucleotide sequence function. Such inhibitors are tested for their ability to inhibit leukocyte adhesion in the in vitro test described above.

Integrated Systems

Integrated systems for the collection and analysis of expression profiles, and molecular signatures, as well as for the compilation, storage and access of the databases of the invention, typically include a digital computer with software including an instruction set for sequence searching and analysis, and, optionally, high-throughput liquid control software, image analysis software, data interpretation software, a robotic control armature for transferring solutions from a source to a destination (such as a detection device) operably linked to the digital computer, an input device (e.g., a computer keyboard) for entering subject data to the digital computer, or to control analysis operations or high throughput sample transfer by the robotic control armature. Optionally, the integrated system further comprises an image scanner for digitizing label signals from labeled assay components, e.g., labeled nucleic acid hybridized to a candidate library microarray. The image scanner can interface with image analysis software to provide a measurement of the presence or intensity of the hybridized label, i.e., indicative of an on/off expression pattern or an increase or decrease in expression.

Readily available computational hardware resources using standard operating systems are fully adequate, e.g., a PC (Intel x86 or Pentium chip-compatible DOS,™ OS2,™ WINDOWS,™ WINDOWS NT,™ WINDOWS95,™ WINDOWS98,™ LINUX, or even Macintosh, Sun or PCs will suffice) for use in the integrated systems of the invention. Current art in software technology is similarly adequate (i.e., there are a multitude of mature programming languages and source code suppliers) for design, e.g., of an upgradeable open-architecture object-oriented heuristic algorithm, or instruction set for expression analysis, as described herein. For example, software for aligning or otherwise manipulating molecular signatures can be constructed by one of skill using a standard programming language such as Visual basic, Fortran, Basic, Java, or the like, according to the methods herein.

Various methods and algorithms, including genetic algorithms and neural networks, can be used to perform the data collection, correlation, and storage functions, as well as other desirable functions, as described herein. In addition, digital or analog systems such as digital or analog computer systems can control a variety of other functions such as the display and/or control of input and output files.

Figure 1:
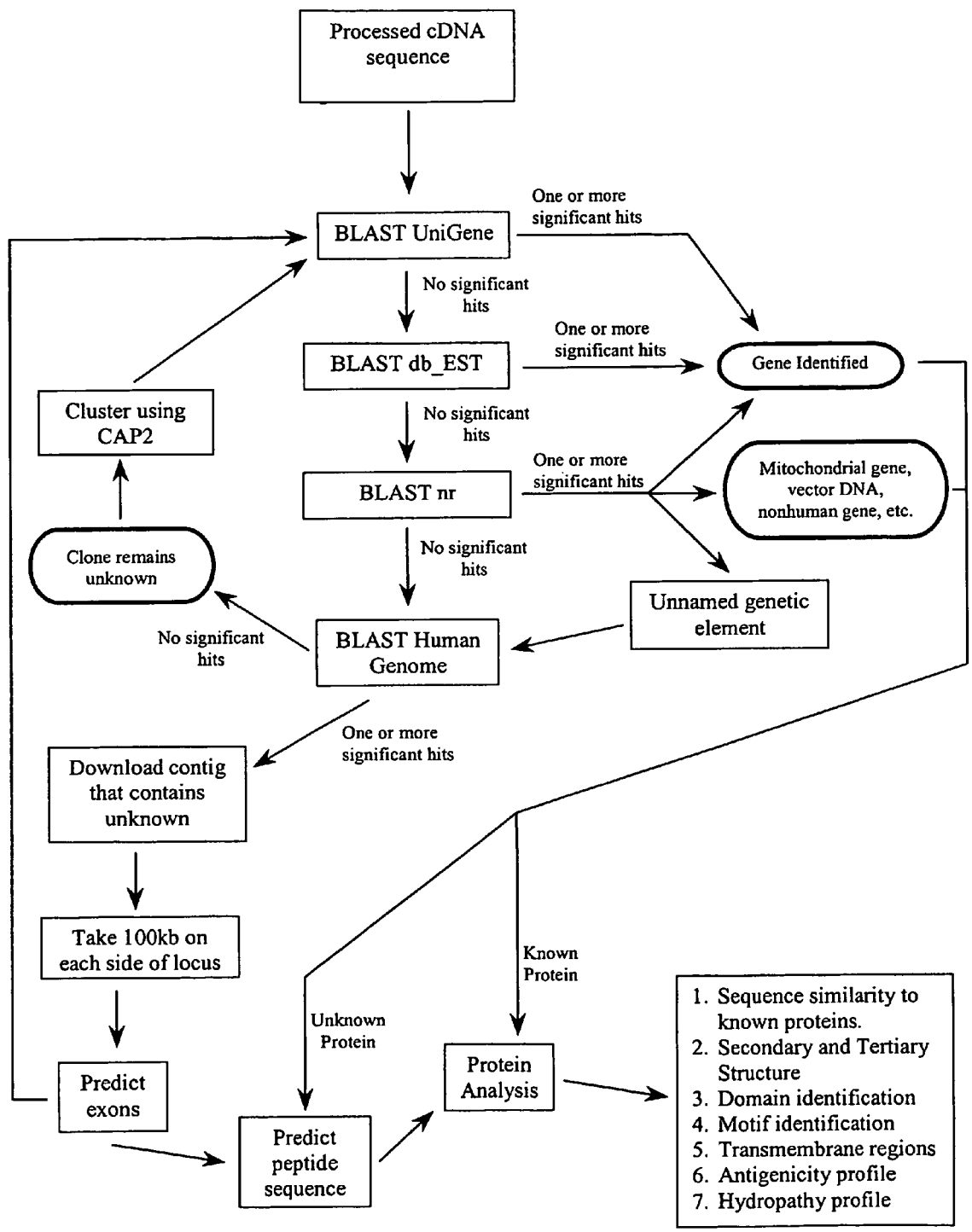
FIG. 1.
Figure 2:
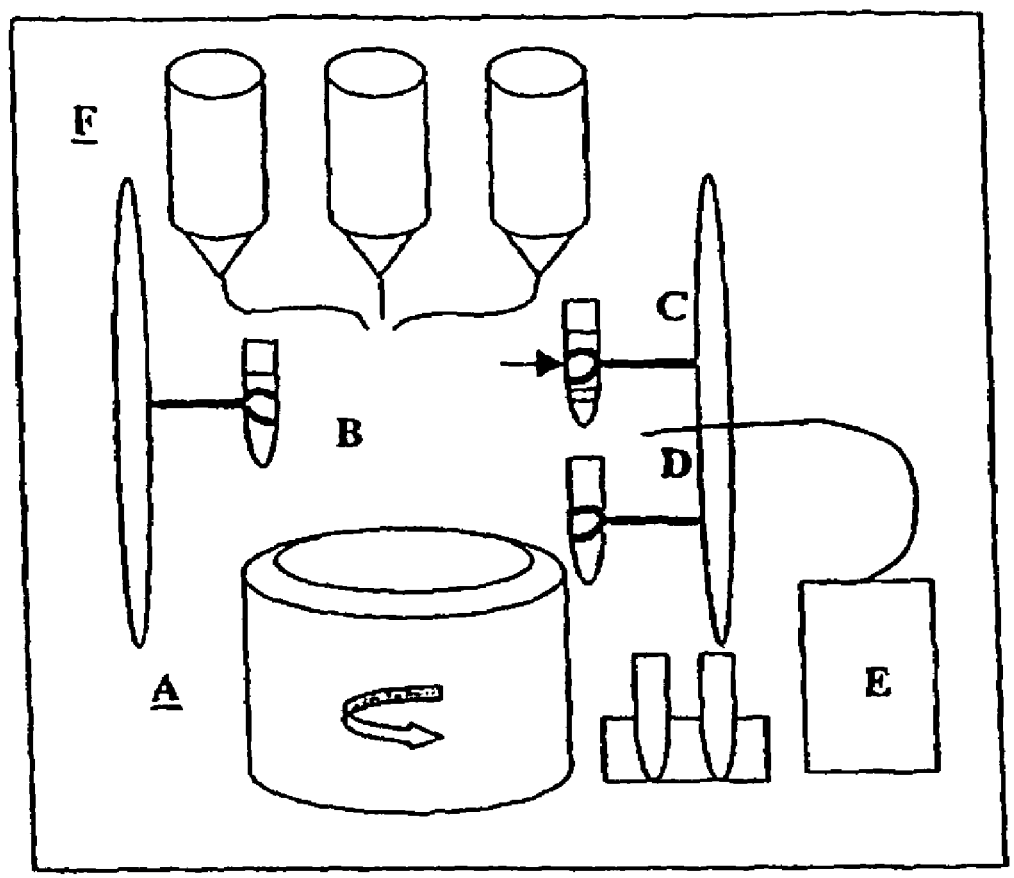
FIG. 2.

For example, standard desktop applications such as word processing software (e.g., Corel WordPerfect™ or Microsoft Word™) and database software (e.g., spreadsheet software such as Corel Quattro Pro™, Microsoft Excel™, or database programs such as Microsoft Access™ or Paradox™) can be adapted to the present invention by inputting one or more character string corresponding, e.g., to an expression pattern or profile, subject medical or historical data, molecular signature, or the like, into the software which is loaded into the memory of a digital system, and carrying out the operations indicated in an instruction set, e.g., as exemplified in FIG. 2.

For example, systems can include the foregoing software having the appropriate character string information, e.g., used in conjunction with a user interface in conjunction with a standard operating system such as a Windows, Macintosh or LINUX system. For example, an instruction set for manipulating strings of characters, either by programming the required operations into the applications or with the required operations performed manually by a user (or both). For example, specialized sequence alignment programs such as PILEUP or BLAST can also be incorporated into the systems of the invention, e.g., for alignment of nucleic acids or proteins (or corresponding character strings).

Software for performing the statistical methods required for the invention, e.g., to determine correlations between expression profiles and subsets of members of the diagnostic nucleotide libraries, such as programmed embodiments of the statistical methods described above, are also included in the computer systems of the invention. Alternatively, programming elements for performing such methods as principle component analysis (PCA) or least squares analysis can also be included in the digital system to identify relationships between data. Exemplary software for such methods is provided by Partek, Inc., St. Peter, Mo.; at the web site partek.com.

Any controller or computer optionally includes a monitor which can include, e.g., a flat panel display (e.g., active matrix liquid crystal display, liquid crystal display), a cathode ray tube ("CRT") display, or another display system which serves as a user interface, e.g., to output predictive data. Computer circuitry, including numerous integrated circuit chips, such as a microprocessor, memory, interface circuits, and the like, is often placed in a casing or box which optionally also includes a hard disk drive, a floppy disk drive, a high capacity removable drive such as a writeable CD-ROM, and other common peripheral elements.

Inputting devices such as a keyboard, mouse, or touch sensitive screen, optionally provide for input from a user and for user selection, e.g., of sequences or data sets to be compared or otherwise manipulated in the relevant computer system. The computer typically includes appropriate software for receiving user instructions, either in the form of user input into a set parameter or data fields (e.g., to input relevant subject data), or in the form of preprogrammed instructions, e.g., preprogrammed for a variety of different specific operations. The software then converts these instructions to appropriate language for instructing the system to carry out any desired operation.

The integrated system may also be embodied within the circuitry of an application specific integrated circuit (ASIC) or programmable logic device (PLD). In such a case, the invention is embodied in a computer readable descriptor language that can be used to create an ASIC or PLD. The integrated system can also be embodied within the circuitry or logic processors of a variety of other digital apparatus, such as PDAs, laptop computer systems, displays, image editing equipment, etc.

The digital system can comprise a learning component where expression profiles, and relevant subject data are compiled and monitored in conjunction with physical assays, and where correlations, e.g., molecular signatures with predictive value for a disease, are established or refined. Successful and unsuccessful combinations are optionally documented in a database to provide justification/preferences for user-base or digital system based selection of diagnostic nucleotide sets with high predictive accuracy for a specified disease or condition.

The integrated systems can also include an automated workstation. For example, such a workstation can prepare and analyze leukocyte RNA samples by performing a sequence of events including: preparing RNA from a human blood sample; labeling the RNA with an isotopic or non-isotopic label; hybridizing the labeled RNA to at least one array comprising all or part of the candidate library; and detecting the hybridization pattern. The hybridization pattern is digitized and recorded in the appropriate database.

Automated RNA Preparation Tool

The invention also includes an automated RNA preparation tool for the preparation of mononuclear cells from whole blood samples, and preparation of RNA from the mononuclear cells. In a preferred embodiment, the use of the RNA preparation tool is fully automated, so that the cell separation and RNA isolation would require no human manipulations. Full automation is advantageous because it minimizes delay, and standardizes sample preparation across different laboratories. This standardization increases the reproducibility of the results.

FIG. 2 depicts the processes performed by the RNA preparation tool of the invention. A primary component of the device is a centrifuge (A). Tubes of whole blood containing a density gradient solution, transcription/translation inhibitors, and a gel barrier that separates erythrocytes from mononuclear cells and serum after centrifugation are placed in the centrifuge (B). The barrier is permeable to erythrocytes and granulocytes during centrifugation, but does not allow mononuclear cells to pass through (or the barrier substance has a density such that mononuclear cells remain above the level of the barrier during the centrifugation). After centrifugation, the erythrocytes and granulocytes are trapped beneath the barrier, facilitating isolation of the mononuclear cell and serum layers. A mechanical arm removes the tube and inverts it to mix the mononuclear cell layer and the serum (C). The arm next pours the supernatant into a fresh tube (D), while the erythrocytes and granulocytes remained below the barrier. Alternatively, a needle is used to aspirate the supernatant and transfer it to a fresh tube. The mechanical arms of the device opens and closes lids, dispenses PBS to aid in the collection of the mononuclear cells by centrifugation, and moves the tubes in and out of the centrifuge. Following centrifugation, the supernatant is poured off or removed by a vacuum device (E), leaving an isolated mononuclear cell pellet. Purification of the RNA from the cells is performed automatically, with lysis buffer and other purification solutions (F) automatically dispensed and removed before and after centrifugation steps. The result is a purified RNA solution. In another embodiment, RNA isolation is performed using a column or filter method. In yet another embodiment, the invention includes an on-board homogenizer for use in cell lysis.

Other Automated Systems

Automated and/or semi-automated methods for solid and liquid phase high-throughput sample preparation and evaluation are available, and supported by commercially available devices. For example, robotic devices for preparation of nucleic acids from bacterial colonies, e.g., to facilitate production and characterization of the candidate library include, for example, an automated colony picker (e.g., the Q-bot, Genetix, U.K.) capable of identifying, sampling, and inoculating up to 10,000/4 hrs different clones into 96 well microtiter dishes. Alternatively, or in addition, robotic systems for liquid handling are available from a variety of sources, e.g., automated workstations like the automated synthesis apparatus developed by Takeda Chemical Industries, LTD. (Osaka, Japan) and many robotic systems utilizing robotic arms (Zymate II, Zymark Corporation, Hopkinton, Mass.; Orca, Beckman Coulter, Inc. (Fullerton, Calif.)) which mimic the manual operations performed by a scientist. Any of the above devices are suitable for use with the present invention, e.g., for high-throughput analysis of library components or subject leukocyte samples. The nature and implementation of modifications to these devices (if any) so that they can operate as discussed herein will be apparent to persons skilled in the relevant art.

High throughput screening systems that automate entire procedures, e.g., sample and reagent pipetting, liquid dispensing, timed incubations, and final readings of the microplate in detector(s) appropriate for the relevant assay are commercially available. (see, e.g., Zymark Corp., Hopkinton, Mass.; Air Technical Industries, Mentor, Ohio; Beckman Instruments, Inc. Fullerton, Calif.; Precision Systems, Inc., Natick, Mass., etc.). These configurable systems provide high throughput and rapid start up as well as a high degree of flexibility and customization. Similarly, arrays and array readers are available, e.g., from Affymetrix, PE Biosystems, and others.

The manufacturers of such systems provide detailed protocols the various high throughput. Thus, for example, Zymark Corp. provides technical bulletins describing screening systems for detecting the modulation of gene transcription, ligand binding, and the like.

A variety of commercially available peripheral equipment, including, e.g., optical and fluorescent detectors, optical and fluorescent microscopes, plate readers, CCD arrays, phosphorimagers, scintillation counters, phototubes, photodiodes, and the like, and software is available for digitizing, storing and analyzing a digitized video or digitized optical or other assay results, e.g., using PC (Intel x86 or pentium chip-compatible DOS™, OS2™ WINDOWS™, WINDOWS NT™ or WINDOWS95™ based machines), MACINTOSH™, or UNIX based (e.g., SUN™ work station) computers.

Embodiment in a Web Site

The methods described above can be implemented in a localized or distributed computing environment. For example, if a localized computing environment is used, an array comprising a candidate nucleotide library, or diagnostic nucleotide set, is configured in proximity to a detector, which is, in turn, linked to a computational device equipped with user input and output features.

In a distributed environment, the methods can be implemented on a single computer with multiple processors or, alternatively, on multiple computers. The computers can be linked, e.g. through a shared bus, but more commonly, the computer(s) are nodes on a network. The network can be generalized or dedicated, at a local level or distributed over a wide geographic area. In certain embodiments, the computers are components of an intra-net or an internet.

The predictive data corresponding to subject molecular signatures (e.g., expression profiles, and related diagnostic, prognostic, or monitoring results) can be shared by a variety of parties. In particular, such information can be utilized by the subject, the subject's health care practitioner or provider, a company or other institution, or a scientist. An individual subject's data, a subset of the database or the entire database recorded in a computer readable medium can be accessed directly by a user by any method of communication, including, but not limited to, the internet. With appropriate computational devices, integrated systems, communications networks, users at remote locations, as well as users located in proximity to, e.g., at the same physical facility, the database can access the recorded information. Optionally, access to the database can be controlled using unique alphanumeric passwords that provide access to a subset of the data. Such provisions can be used, e.g., to ensure privacy, anonymity, etc.

Typically, a client (e.g., a patient, practitioner, provider, scientist, or the like) executes a Web browser and is linked to a server computer executing a Web server. The Web browser is, for example, a program such as IBM's Web Explorer, Internet explorer, NetScape or Mosaic, or the like. The Web server is typically, but not necessarily, a program such as IBM's HTTP Daemon or other WWW daemon (e.g., LINUX-based forms of the program). The client computer is bi-directionally coupled with the server computer over a line or via a wireless system. In turn, the server computer is bi-directionally coupled with a website (server hosting the website) providing access to software implementing the methods of this invention.

A user of a client connected to the Intranet or Internet may cause the client to request resources that are part of the web site(s) hosting the application(s) providing an implementation of the methods described herein. Server program(s) then process the request to return the specified resources (assuming they are currently available). A standard naming convention has been adopted, known as a Uniform Resource Locator ("URL"). This convention encompasses several types of location names, presently including subclasses such as Hypertext Transport Protocol ("http"), File Transport Protocol ("ftp"), gopher, and Wide Area Information Service ("WAIS"). When a resource is downloaded, it may include the URLs of additional resources. Thus, the user of the client can easily learn of the existence of new resources that he or she had not specifically requested.

Methods of implementing Intranet and/or Intranet embodiments of computational and/or data access processes are well known to those of skill in the art and are documented, e.g., in ACM Press, pp. 383-392; ISO-ANSI, Working Draft, "Information Technology-Database Language SQL", Jim Melton, Editor, International Organization for Standardization and American National Standards Institute, July 1992; ISO Working Draft, "Database Language SQL-Part 2:Foundation (SQL/Foundation)", CD9075-2:199.chi.SQL, Sep. 11, 1997; and Cluer et al. (1992) A General Framework for the Optimization of Object-Oriented Queries, Proc SIGMOD International Conference on Management of Data, San Diego, Calif., Jun. 2-5, 1992, SIGMOD Record, vol. 21, Issue 2, Jun., 1992; Stonebraker, M., Editor. Other resources are available, e.g., from Microsoft, IBM, Sun and other software development companies.

Using the tools described above, users of the reagents, methods and database as discovery or diagnostic tools can query a centrally located database with expression and subject data. Each submission of data adds to the sum of expression and subject information in the database. As data is added, a new correlation statistical analysis is automatically run that incorporates the added clinical and expression data. Accordingly, the predictive accuracy and the types of correlations of the recorded molecular signatures increases as the database grows.

For example, subjects, such as patients, can access the results of the expression analysis of their leukocyte samples and any accrued knowledge regarding the likelihood of the patient's belonging to any specified diagnostic (or prognostic, or monitoring, or risk group), i.e., their expression profiles, and/or molecular signatures. Optionally, subjects can add to the predictive accuracy of the database by providing additional information to the database regarding diagnoses, test results, clinical or other related events that have occurred since the time of the expression profiling. Such information can be provided to the database via any form of communication, including, but not limited to, the internet. Such data can be used to continually define (and redefine) diagnostic groups. For example, if 1000 patients submit data regarding the occurrence of myocardial infarction over the 5 years since their expression profiling, and 300 of these patients report that they have experienced a myocardial infarction and 700 report that they have not, then the 300 patients define a new "group A." As the algorithm is used to continually query and revise the database, a new diagnostic nucleotide set that differentiates groups A and B (i.e., with and without myocardial infarction within a five year period) is identified. This newly defined nucleotide set is then be used (in the manner described above) as a test that predicts the occurrence of myocardial infarction over a five-year period. While submission directly by the patient is exemplified above, any individual with access and authority to submit the relevant data e.g., the patient's physician, a laboratory technician, a health care or study administrator, or the like, can do so.

As will be apparent from the above examples, transmission of information via the internet (or via an intranet) is optionally bi-directional. That is, for example, data regarding expression profiles, subject data, and the like are transmitted via a communication system to the database, while information regarding molecular signatures, predictive analysis, and the like, are transmitted from the database to the user. For example, using appropriate configurations of an integrated system including a microarray comprising a diagnostic nucleotide set, a detector linked to a computational device can directly transmit (locally or from a remote workstation at great distance, e.g., hundreds or thousands of miles distant from the database) expression profiles and a corresponding individual identifier to a central database for analysis according to the methods of the invention. According to, e.g., the algorithms described above, the individual identifier is assigned to one or more diagnostic (or prognostic, or monitoring, etc.) categories. The results of this classification are then relayed back, via, e.g., the same mode of communication, to a recipient at the same or different internet (or intranet) address.

Kits

The present invention is optionally provided to a user as a kit. Typically, a kit contains one or more diagnostic nucleotide sets of the invention. Alternatively, the kit contains the candidate nucleotide library of the invention. Most often, the kit contains a diagnostic nucleotide probe set, or other subset of a candidate library, e.g., as a cDNA or antibody microarray packaged in a suitable container. The kit may further comprise, one or more additional reagents, e.g., substrates, labels, primers, for labeling expression products, tubes and/or other accessories, reagents for collecting blood samples, buffers, e.g., erythrocyte lysis buffer, leukocyte lysis buffer, hybridization chambers, cover slips, etc., as well as a software package, e.g., including the statistical methods of the invention, e.g., as described above, and a password and/or account number for accessing the compiled database. The kit optionally further comprises an instruction set or user manual detailing preferred methods of using the diagnostic nucleotide sets in the methods of the invention. In one embodiment, the kit may include contents useful for the discovery of diagnostic nucleotide sets using microarrays. The kit may include sterile, endotoxin and RNAse free blood collection tubes. The kit may also include alcohol swabs, tourniquet, blood collection set, and/or PBS (phosphate buffer saline; needed when method of example 2 is used to derived mononuclear RNA).

The kit may also include cell lysis buffer. The kit may include RNA isolation kit, substrates for labeling of RNA (may vary for various expression profiling techniques). The kit may also include materials for fluorescence microarray expression profiling, including one or more of the following: reverse transcriptase and 10×RT buffer, T7(dT)24 primer (primer with T7 promoter at 5' end), DTT, deoxynucleotides, optionally 100 mM each, RNAse inhibitor, second strand cDNA buffer, DNA polymerase, Rnase H, T7 RNA polymerase ribonucleotides, in vitro transcription buffer, and/or Cy3 and Cy5 labeled ribonucleotides. The kit may also include microarrays containing candidate gene libraries, cover slips for slides, and/or hybridization chambers. The kit may further include software package for identification of diagnostic gene set from data, that contains statistical methods, and/or allows alteration in desired sensitivity and specificity of gene set. The software may further facilitate access to and data analysis by centrally a located database server. The software may further include a password and account number to access central database server. In addition, the kit may include a kit user manual.

In another embodiment, the kit may include contents useful for the application of diagnostic nucleotide sets using microarrays. The kit may include sterile, endotoxin and/or RNAse free blood collection tubes. The kit may also include, alcohol swabs, tourniquet, and/or a blood collection set. The kit may further include PBS (phosphate buffer saline; needed when method of example 2 is used to derived mononuclear RNA), cell lysis buffer, and/or an RNA isolation kit. In addition, the kit may include substrates for labeling of RNA (may vary for various expression profiling techniques). For fluorescence microarray expression profiling, components may include reverse transcriptase and 10×RT buffer, T7(dT)24 primer (primer with T7 promoter at 5' end), DTT, deoxynucleotides (optionally 100 mM each), RNAse inhibitor, second strand cDNA buffer, DNA polymerase, Rnase H, T7 RNA polymerase, ribonucleotides, in vitro transcription buffer, and/or Cy3 and Cy5 labeled ribonucleotides. The kit may further include microarrays containing candidate gene libraries. The kit may also include cover slips for slides, and/or hybridization chambers. The kit may include a software package for identification of diagnostic gene set from data. The software package may contain statistical methods, allow alteration in desired sensitivity and specificity of gene set, and/or facilitate access to and data analysis by centrally located database server. The software package may include a password and account number to access central database server. In addition, the kit may include a kit user manual.

In another embodiment, the kit may include contents useful for the application of diagnostic nucleotide sets using real-time PCR. This kit may include terile, endotoxin and/or RNAse free blood collection tubes. The kit may further include alcohol swabs, tourniquet, and/or a blood collection set. The kit may also include PBS (phosphate buffer saline; needed when method of example 2 is used to derived mononuclear RNA). In addition, the kit may include cell lysis buffer and/or an RNA isolation kit. The kit may laso include substrates for real time RT-PCR, which may vary for various real-time PCR techniques, including poly dT primers, random hexamer primers, reverse Transcriptase and RT buffer, DTT, deoxynucleotides 100 mM, RNase H, primer pairs for diagnostic and control gene set, 10×PCR reaction buffer, and/or Taq DNA polymerase. The kit may also include fluorescent probes for diagnostic and control gene set (alternatively, fluorescent dye that binds to only double stranded DNA). The kit may further include reaction tubes with or without barcode for sample tracking, 96-well plates with barcode for sample identification, one barcode for entire set, or individual barcode per reaction tube in plate. The kit may also include a software package for identification of diagnostic gene set from data, and/or statistical methods. The software package may allow alteration in desired sensitivity and specificity of gene set, and/or facilitate access to and data analysis by centrally located database server. The kit may include a password and account number to access central database server. Finally, the kit may include a kit user manual.

This invention will be better understood by reference to the following non-limiting Examples:

List of Example Titles

Example 1: Preparation of a leukocyte cDNA array comprising a candidate gene library Example 2: Preparation of RNA from mononuclear cells for expression profiling Example 3: Preparation of Universal Control RNA for use in leukocyte expression profiling Example 4. RNA Labeling and hybridization to a leukocyte cDNA array of candidate nucleotide sequences.

Example 5: Clinical study for the Identification of diagnostic gene sets useful in diagnosis and treatment of Cardiac allograft rejection Example 6: Identification of diagnostic nucleotide sets for kidney and liver allograft rejection Example 7: Identification of diagnostic nucleotide sets for diagnosis of cytomegalovirus Example 8: Design of oligonucleotide probes Example 9: Production of an array of 8,000 spotted 50 mer oligonucleotides.

Example 10: Identification of diagnostic nucleotide sets for diagnosis of Cardiac Allograft Rejection using microarrays Example 11: Amplification, labeling, and hybridization of total RNA to an oligonucleotide microarray Example 12: Real-time PCR validation of array expression results Example 13: Real-time PCR expression markers of acute allograft rejection Example 14: Identification of diagnostic nucleotide sets for diagnosis of Cardiac Allograft Rejection using microarrays Example 15: Correlation and Classification Analysis Example 16: Acute allograft rejection: biopsy tissue gene expression profiling Example 17: Microarray and PCR gene expression panels for diagnosis and monitoring of acute allograft rejection Example 18: Assay sample preparation Example 19: Allograft rejection diagnostic gene sequence analysis Example 20: Detection of proteins expressed by diagnostic gene sequences Example 21: Detecting changes in the rate of hematopoiesis

EXAMPLES

Example 1

Preparation of a Leukocyte cDNA Array Comprising a Candidate Gene Library

Candidate genes and gene sequences for leukocyte expression profiling are identified through methods described elsewhere in this document. Candidate genes are used to obtain or design probes for peripheral leukocyte expression profiling in a variety of ways.

A cDNA microarray carrying 384 probes was constructed using sequences selected from the initial candidate library. cDNAs is selected from T-cell libraries, PBMC libraries and buffy coat libraries.

96-Well PCR

Plasmids are isolated in 96-well format and PCR was performed in 96-well format. A master mix is made that contain the reaction buffer, dNTPs, forward and reverse primer and DNA polymerase was made. 99 ul of the master mix was aliquoted into 96-well plate. 1 ul of plasmid (1-2 ng/ul) of plasmid was added to the plate. The final reaction concentration was 10 mM Tris pH 8.3, 3.5 mM MgCl2, 25 mM KCl, 0.4 mM dNTPs, 0.4 uM M13 forward primer, 0.4 M13 reverse primer, and 10 U of Taq Gold (Applied Biosystems). The PCR conditions were:

Step 1 95 C for 10 min

Step 2 95 C for 15 sec

Step 3 56 C for 30 sec

Step 4 72 C for 2 min 15 seconds

Step 5 go to Step 2 39 times

Step 6 72 C for 10 minutes

Step 7 4 C for ever.

PCR Purification

PCR purification is done in a 96-well format. The ArrayIt (Telechem International, Inc.) PCR purification kit is used and the provided protocol was followed without modification. Before the sample is evaporated to dryness, the concentration of PCR products was determined using a spectrophotometer. After evaporation, the samples are re-suspended in 1× Micro Spotting Solution (ArrayIt) so that the majority of the samples were between 0.2-1.0 ug/ul.

Array Fabrication

Spotted cDNA microarrays are then made from these PCR products by ArrayIt using their protocols, which may be found at the ArrayIt website. Each fragment was spotted 3 times onto each array. Candidate genes and gene sequences for leukocyte expression profiling are identified through methods described elsewhere in this document. Those candidate genes are used for peripheral leukocyte expression profiling. The candidate libraries can be used to obtain or design probes for expression profiling in a variety of ways.

Oligonucleotide probes are prepared using the gene sequences of Table 2, Table 8, and the sequence listing. Oligo probes are designed on a contract basis by various companies (for example, Compugen, Mergen, Affymnetrix, Telechem), or designed from the candidate sequences using a variety of parameters and algorithms as indicated at located at the MIT web site. Briefly, the length of the oligonucleotide to be synthesized is determined, preferably greater than 18 nucleotides, generally 18-24 nucleotides, 24-70 nucleotides and, in some circumstances, more than 70 nucleotides. The sequence analysis algorithms and tools described above are applied to the sequences to mask repetitive elements, vector sequences and low complexity sequences. Oligonucleotides are selected that are specific to the candidate nucleotide sequence (based on a Blast n search of the oligonucleotide sequence in question against gene sequences databases, such as the Human Genome Sequence, UniGene, dbEST or the non-redundant database at NCBI), and have <50% G content and 25-70% G+C content. Desired oligonucleotides are synthesized using well-known methods and apparatus, or ordered from a company (for example Sigma). Oligonucleotides are spotted onto microarrays. Alternatively, oligonucleotides are synthesized directly on the array surface, using a variety of techniques (Hughes et al. 2001, Yershov et al. 1996, Lockhart et al 1996).

Example 2

Preparation of RNA from Mononuclear Cells for Expression Profiling

Blood was isolated from the subject for leukocyte expression profiling using the following methods: Two tubes were drawn per patient. Blood was drawn from either a standard peripheral venous blood draw or directly from a large-bore intra-arterial or intravenous catheter inserted in the femoral artery, femoral vein, subclavian vein or internal jugular vein. Care was taken to avoid sample contamination with heparin from the intravascular catheters, as heparin can interfere with subsequent RNA reactions. For each tube, 8 ml of whole blood was drawn into a tube (CPT, Becton-Dickinson order #362753) containing the anticoagulant Citrate, 25° C. density gradient solution (e.g. Ficoll, Percoll) and a polyester gel barrier that upon centrifugation was permeable to RBCs and granulocytes but not to mononuclear cells. The tube was inverted several times to mix the blood with the anticoagulant. The tubes were centrifuged at 1750×g in a swing-out rotor at room temperature for 20 minutes. The tubes were removed from the centrifuge and inverted 5-10 times to mix the plasma with the mononuclear cells, while trapping the RBCs and the granulocytes beneath the gel barrier. The plasma/mononuclear cell mix was decanted into a 15 ml tube and 5 ml of phosphate-buffered saline (PBS) is added. The 15 ml tubes were spun for 5 minutes at 1750×g to pellet the cells. The supernatant was discarded and 1.8 ml of RLT lysis buffer is added to the mononuclear cell pellet. The buffer and cells were pipetted up and down to ensure complete lysis of the pellet. The cell lysate was frozen and stored until it is convenient to proceed with isolation of total RNA.

Total RNA was purified from the lysed mononuclear cells using the Qiagen Rneasy Miniprep kit, as directed by the manufacturer (10/99 version) for total RNA isolation, including homogenization (Qiashredder columns) and on-column DNase treatment. The purified RNA was eluted in 50 ul of water. The further use of RNA prepared by this method is described in Examples 10 and 11.

Some samples were prepared by a different protocol, as follows:

Two 8 ml blood samples were drawn from a peripheral vein into a tube (CPT, Becton-Dickinson order #362753) containing anticoagulant (Citrate), 25° C. density gradient solution (Ficoll) and a polyester gel barrier that upon centrifugation is permeable to RBCs and granulocytes but not to mononuclear cells. The mononuclear cells and plasma remained above the barrier while the RBCs and granulocytes were trapped below. The tube was inverted several times to mix the blood with the anticoagulant, and the tubes were subjected to centrifugation at 1750×g in a swing-out rotor at room temperature for 20 min. The tubes were removed from the centrifuge, and the clear plasma layer above the cloudy mononuclear cell layer was aspirated and discarded. The cloudy mononuclear cell layer was aspirated, with care taken to rinse all of the mononuclear cells from the surface of the gel barrier with PBS (phosphate buffered saline). Approximately 2 mls of mononuclear cell suspension was transferred to a 2 ml microcentrifuge tube, and centrifuged for 3 min. at 16,000 rpm in a microcentrifuge to pellet the cells. The supernatant was discarded and 1.8 ml of RLT lysis buffer (Qiagen) were added to the mononuclear cell pellet, which lysed the cells and inactivated Rnases. The cells and lysis buffer were pipetted up and down to ensure complete lysis of the pellet. Cell lysate was frozen and stored until it was convenient to proceed with isolation of total RNA.

RNA samples were isolated from 8 mL of whole blood. Yields ranged from 2 ug to 20 ug total RNA for 8 mL blood. A260/A280 spectrophotometric ratios were between 1.6 and 2.0, indicating purity of sample. 2 ul of each sample were run on an agarose gel in the presence of ethidium bromide. No degradation of the RNA sample and no DNA contamination was visible.

In some cases, specific subsets of mononuclear cells were isolated from peripheral blood of human subjects. When this was done, the StemSep cell separation kits (manual version 6.0.0) were used from StemCell Technologies (Vancouver, Canada). This same protocol can be applied to the isolation of T cells, CD4 T cells, CD8 T cells, B cells, monocytes, NK cells and other cells. Isolation of cell types using negative selection with antibodies may be desirable to avoid activation of target cells by antibodies.

Example 3

Preparation of Universal Control RNA for Use in Leukocyte Expression Profiling

Control RNA was prepared using total RNA from Buffy coats and/or total RNA from enriched mononuclear cells isolated from Buffy coats, both with and without stimulation with ionomycin and PMA. The following control RNAs were prepared:

Control 1: Buffy Coat Total RNA

Control 2: Mononuclear cell Total RNA

Control 3: Stimulated buffy coat Total RNA

Control 4: Stimulated mononuclear Total RNA

Control 5: 50% Buffy coat Total RNA/50% Stimulated buffy coat Total RNA

Control 6: 50% Mononuclear cell Total RNA/50% Stimulated Mononuclear Total RNA

Some samples were prepared using the following protocol: Buffy coats from 38 individuals were obtained from Stanford Blood Center. Each buffy coat is derived from ~350 mL whole blood from one individual. 10 ml buffy coat was removed from the bag, and placed into a 50 ml tube. 40 ml of Buffer EL (Qiagen) was added, the tube was mixed and placed on ice for 15 minutes, then cells were pelleted by centrifugation at 2000×g for 10 minutes at 4° C. The supernatant was decanted and the cell pellet was re-suspended in 10 ml of Qiagen Buffer EL. The tube was then centrifuged at 2000×g for 10 minutes at 4° C. The cell pellet was then re-suspended in 20 ml TRIZOL (GibcoBRL) per Buffy coat sample, the mixture was shredded using a rotary homogenizer, and the lysate was then frozen at −80° C. prior to proceeding to RNA isolation.

Other control RNAs were prepared from enriched mononuclear cells prepared from Buffy coats. Buffy coats from Stanford Blood Center were obtained, as described above. 10 ml buffy coat was added to a 50 ml polypropylene tube, and 10 ml of phosphate buffer saline (PBS) was added to each tube. A polysucrose (5.7 g/dL) and sodium diatrizoate (9.0 g/dL) solution at a 1.077+/−0.0001 g/ml density solution of equal volume to diluted sample was prepared (Histopaque 1077, Sigma cat. no 1077-1). This and all subsequent steps were performed at room temperature. 15 ml of diluted buffy coat/PBS was layered on top of 15 ml of the histopaque solution in a 50 ml tube. The tube was centrifuged at 400×g for 30 minutes at room temperature. After centrifugation, the upper layer of the solution to within 0.5 cm of the opaque interface containing the mononuclear cells was discarded. The opaque interface was transferred into a clean centrifuge tube. An equal volume of PBS was added to each tube and centrifuged at 350×g for 10 minutes at room temperature. The supernatant was discarded. 5 ml of Buffer EL (Qiagen) was used to resuspend the remaining cell pellet and the tube was centrifuged at 2000×g for 10 minutes at room temperature. The supernatant was discarded. The pellet was resuspended in 20 ml of TRIZOL (GibcoBRL) for each individual buffy coat that was processed. The sample was homogenized using a rotary homogenizer and frozen at −80 C until RNA was isolated. RNA was isolated from frozen lysed Buffy coat samples as follows: frozen samples were thawed, and 4 ml of chloroform was added to each buffy coat sample. The sample was mixed by vortexing and centrifuged at 2000×g for 5 minutes. The aqueous layer was moved to new tube and then repurified by using the RNeasy Maxi RNA clean up kit, according to the manufacturer's instruction (Qiagen, PN 75162). The yield, purity and integrity were assessed by spectrophotometer and gel electrophoresis. Some samples were prepared by a different protocol, as follows. The further use of RNA prepared using this protocol is described in Example 11.

50 whole blood samples were randomly selected from consented blood donors at the Stanford Medical School Blood Center. Each huffy coat sample was produced from ~350 mL of an individual's donated blood. The whole blood sample was centrifuged at ~4,400×g for 8 minutes at room temperature, resulting in three distinct layers: a top layer of plasma, a second layer of buffy coat, and a third layer of red blood cells. 25 ml of the buffy coat fraction was obtained and diluted with an equal volume of PBS (phosphate buffered saline). 30 ml of diluted huffy coat was layered onto 15 ml of sodium diatrizoate solution adjusted to a density of 1.077+/− 0.001 g/ml (Histopaque 1077, Sigma) in a 50 mL plastic tube. The tube was spun at 800 g for 10 minutes at room temperature. The plasma layer was removed to the 30 ml mark on the tube, and the mononuclear cell layer removed into a new tube and washed with an equal volume of PBS, and collected by centrifugation at 2000 g for 10 minutes at room temperature. The cell pellet was resuspended in 10 ml of Buffer EL (Qiagen) by vortexing and incubated on ice for 10 minutes to remove any remaining erthythrocytes. The mononuclear cells were spun at 2000 g for 10 minutes at 4 degrees Celsius. The cell pellet was lysed in 25 ml of a phenol/guanidinium thiocyanate solution (TRIZOL Reagent, Invitrogen). The sample was homogenized using a PowerGene 5 rotary homogenizer (Fisher Scientific) and Omini disposable generator probes (Fisher Scientific). The Trizol lysate was frozen at −80 degrees C. until the next step.

The samples were thawed out and incubated at room temperature for 5 minutes. 5 ml chloroform was added to each sample, mixed by vortexing, and incubated at room temperature for 3 minutes. The aqueous layers were transferred to new 50 ml tubes. The aqueous layer containing total RNA was further purified using the Qiagen RNeasy Maxi kit (PN 75162), per the manufacturer's protocol (October 1999). The columns were eluted twice with 1 ml Rnase-free water, with a minute incubation before each spin. Quantity and quality of RNA was assessed using standard methods. Generally, RNA was isolated from batches of 10 buffy coats at a time, with an average yield per buffy coat of 870 µg, and an estimated total yield of 43.5 mg total RNA with a 260/280 ratio of 1.56 and a 28S/18S ratio of 1.78.

Quality of the RNA was tested using the Agilent 2100 Bioanalyzer using RNA 6000 microfluidics chips. Analysis of the electrophorgrams from the Bioanalyzer for five different batches demonstrated the reproducibility in quality between the batches.

Total RNA from all five batches were combined and mixed in a 50 ml tube, then aliquoted as follows: 2×10 ml aliquots in 15 ml tubes, and the rest in 100 µl aliquots in 1.5 ml microcentrifuge tubes. The aliquots gave highly reproducible results with respect to RNA purity, size and integrity. The RNA was stored at −80° C.

Test Hybridization of Reference RNA.

Figure 3:
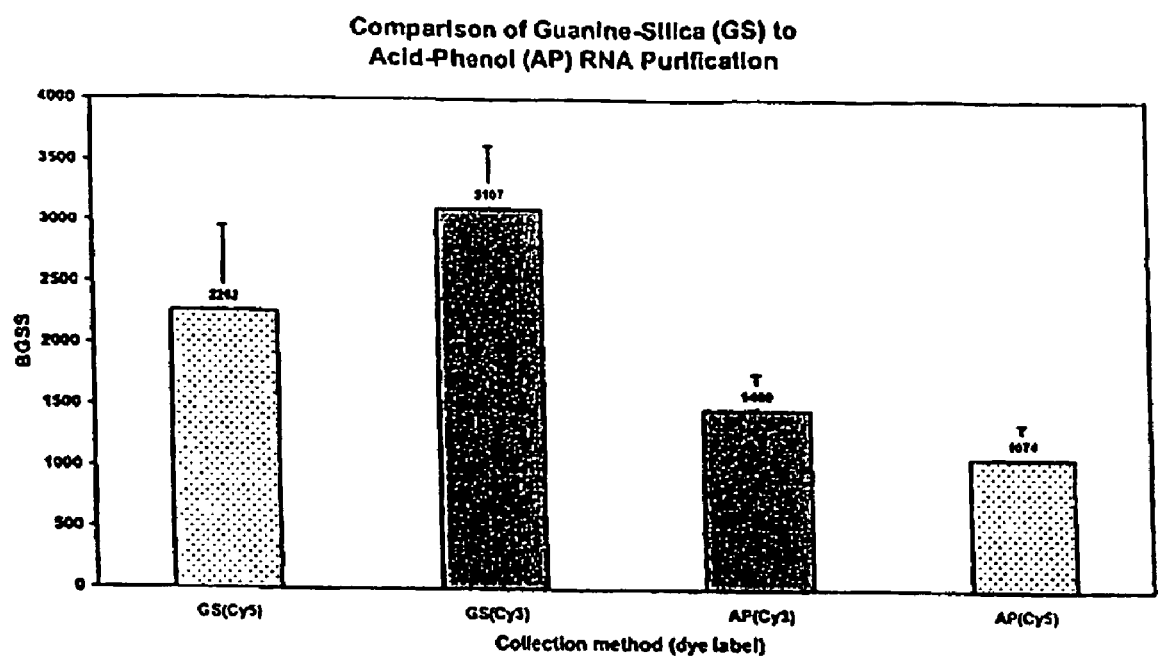
FIG. 3 shows the results of six hybridizations on a mini array graphed (n=6 for each column). The error bars are the SEM. This experiment shows that the average signal from AP prepared RNA is 47% of the average signal from GS prepared RNA for both Cy3 and Cy5.

When compared with BC38 and Stimulated mononuclear reference samples, the R50 performed as well, if not better than the other reference samples as shown in FIG. 3. In an analysis of hybridizations, where the R50 targets were fluorescently labeled with Cy-5 using methods described herein and the amplified and labeled aRNA was hybridized (as in example 11) to the olignucleotide array described in example 9. The R50 detected 97.3% of probes with a Signal to Noise ratio (S/N) of greater than three and 99.9% of probes with S/N greater than one.

Example 4

RNA Labeling and Hybridization to a Leukocyte cDNA Array of Candidate Nucleotide Sequences Comparison of Guanine-Silica to Acid-Phenol RNA Purification (GSvsAP)

These data are from a set of 12 hybridizations designed to identify differences between the signal strength from two different RNA purification methods. The two RNA methods used were guanidine-silica (GS, Qiagen) and acid-phenol (AP, Trizol, Gibco BRL). Ten tubes of blood were drawn from each of four people. Two were used for the AP prep, the other eight were used for the GS prep. The protocols for the leukocyte RNA preps using the AP and GS techniques were completed as described here:

Guanidine-Silica (GS) Method:

For each tube, 8 ml blood was drawn into a tube containing the anticoagulant Citrate, 25° C. density gradient solution and a polyester gel barrier that upon centrifugation is permeable to RBCs and granulocytes but not to mononuclear cells. The mononuclear cells and plasma remained above the barrier while the RBCs and granulocytes were trapped below. CPT tubes from Becton-Dickinson (#362753) were used for this purpose. The tube was inverted several times to mix the blood with the anticoagulant. The tubes were immediately centrifuged @1750×g in a swinging bucket rotor at room temperature for 20 min. The tubes were removed from the centrifuge and inverted 5-10 times. This mixed the plasma with the mononuclear cells, while the RBCs and the granulocytes remained trapped beneath the gel barrier. The plasma/mononuclear cell mix was decanted into a 15 ml tube and 5 ml of phosphate-buffered saline (PBS) was added. The 15 ml tubes are spun for 5 minutes at 1750×g to pellet the cells. The supernatant was discarded and 1.8 ml of RLT lysis buffer (guanidine isothyocyanate) was added to the mononuclear cell pellet. The buffer and cells were pipetted up and down to ensure complete lysis of the pellet. The cell lysate was then processed exactly as described in the Qiagen Rneasy Miniprep kit protocol (10/99 version) for total RNA isolation (including steps for homogenization (Qiashredder columns) and on-column DNase treatment. The purified RNA was eluted in 50 ul of water.

Acid-Phenol (AP) Method:

For each tube, 8 ml blood was drawn into a tube containing the anticoagulant Citrate, 25° C. density gradient solution and a polyester gel barrier that upon centrifugation is permeable to RBCs and granulocytes but not to mononuclear cells. The mononuclear cells and plasma remained above the barrier while the RBCs and granulocytes were trapped below. CPT tubes from Becton-Dickinson (#362753) were used for this purpose. The tube was inverted several times to mix the blood with the anticoagulant. The tubes were immediately centrifuged @1750×g in a swinging bucket rotor at room temperature for 20 min. The tubes were removed from the centrifuge and inverted 5-10 times. This mixed the plasma with the mononuclear cells, while the RBCs and the granulocytes remained trapped beneath the gel barrier. The plasma/mononuclear cell mix was decanted into a 15 ml tube and 5 ml of phosphate-buffered saline (PBS) was added. The 15 ml tubes are spun for 5 minutes @1750×g to pellet the cells. The supernatant was discarded and the cell pellet was lysed using 0.6 mL Phenol/guanidine isothyocyanate (e.g. Trizol reagent, GibcoBRL). Subsequent total RNA isolation proceeded using the manufacturers protocol.

RNA from each person was labeled with either Cy3 or Cy5, and then hybridized in pairs to the mini-array. For instance, the first array was hybridized with GS RNA from one person (Cy3) and GS RNA from a second person (Cy5).

Techniques for labeling and hybridization for all experiments discussed here were completed as detailed above. Arrays were prepared as described in example 1.

RNA isolated from subject samples, or control Buffy coat RNA, were labeled for hybridization to a cDNA array. Total RNA (up to 100 μg) was combined with 2 μl of 100 μM solution of an Oligo (dT)12-18 (GibcoBRL) and heated to 70° C. for 10 minutes and place on ice. Reaction buffer was added to the tube, to a final concentration of 1×RT buffer (GibcoBRL), 10 mM DTT (GibcoBRL), 0.1 mM unlabeled dATP, dTTP, and dGTP, and 0.025 mM unlabeled dCTP, 200 pg of CAB (*A. thaliana* photosystem I chlorophyll a/b binding protein), 200 pg of RCA (*A. thaliana* RUBISCO activase), 0.25 mM of Cy-3 or Cy-5 dCTP, and 400 U Superscript II RT (GibcoBRL).

The volumes of each component of the labeling reaction were as follows: 20 μl of 5×RT buffer; 10 μl of 100 mM DTT; 1 μl of 10 mM dNTPs without dCTP; 0.5 μl of 5 mM CTP; 13 μl of H20; 0.02 μl of 10 ng/μl CAB and RCA; 1 μl of 40 Units/μl RNAseOUT Recombinant Ribonuclease Inhibitor (GibcoBRL); 2.5 μl of 1.0 mM Cy-3 or Cy-5 dCTP; and 2.0 μl of 200 Units/∞1 of Superscript II RT. The sample was vortexed and centrifuged. The sample was incubated at 4° C. for 1 hour for first strand cDNA synthesis, then heated at 70° C. for 10 minutes to quench enzymatic activity. 1 μl of 10 mg/ml of Rnase A was added to degrade the RNA strand, and the sample was incubated at 37° C. for 30 minutes. Next, the Cy-3 and Cy-5 cDNA samples were combined into one tube. Unincorporated nucleotides were removed using QIAquick RCR purification protocol (Qiagen), as directed by the manufacturer. The sample was evaporated to dryness and resuspended in 5 μl of water. The sample was mixed with hybridization buffer containing 5×SSC, 0.2% SDS, 2 mg/ml Cot-1 DNA (GibcoBRL), 1 mg/ml yeast tRNA (GibcoBRL), and 1.6 ng/μl poly dA40-60 (Pharmacia). This mixture was placed on the microarray surface and a glass cover slip was placed on the array (Corning). The microarray glass slide was placed into a hybridization chamber (ArrayIt). The chamber was then submerged in a water bath overnight at 62° C. The microarray was removed from the cassette and the cover slip was removed by repeatedly submerging it to a wash buffer containing 1×SSC, and 0.1% SDS. The microarray slide was washed in 1×SSC/0.1% SDS for 5 minutes. The slide was then washed in 0.1% SSC/0.1% SDS for 5 minutes. The slide was finally washed in 0.1×SSC for 2 minutes. The slide was spun at 1000 rpm for 2 minutes to dry out the slide, then scanned on a microarray scanner (Axon Instruments, Union City, Calif.).

Six hybridizations with 20 μg of RNA were performed for each type of RNA preparation (GS or AP). Since both the Cy3 and the Cy5 labeled RNA are from test preparations, there are six data points for each GS prepped, Cy3-labeled RNA and six for each GS-prepped, Cy5-labeled RNA. The mini array hybridizations were scanned on and Axon Instruments scanner using GenPix 3.0 software. The data presented were derived as follows. First, all features flagged as "not found" by the software were removed from the dataset for individual hybridizations. These features are usually due to high local background or other processing artifacts. Second, the median fluorescence intensity minus the background fluorescence intensity was used to calculate the mean background subtracted signal for each dye for each hybridization. In FIG. 3, the mean of these means across all six hybridizations is graphed (n=6 for each column). The error bars are the SEM. This experiment shows that the average signal from AP prepared RNA is 47% of the average signal from GS prepared RNA for both Cy3 and Cy5.

Generation of Expression Data for Leukocyte Genes from Peripheral Leukocyte Samples Six hybridizations were performed with RNA purified from human blood leukocytes using the protocols given above. Four of the six were prepared using the GS method and 2 were prepared using the AP method. Each preparation of leukocyte RNA was labeled with Cy3 and 10 μg hybridized to the mini-array. A control RNA was batch labeled with Cy5 and 10 μg hybridized to each mini-array together with the Cy3-labeled experimental RNA.

The control RNA used for these experiments was Control 1: Buffy Coat RNA, as described above.

The protocol for the preparation of that RNA is reproduced here:

Buffy Coat RNA Isolation:

Buffy coats were obtained from Stanford Blood Center (in total 38 individual buffy coats were used. Each buffy coat is derived from ~350 mL whole blood from one individual. 10 ml buffy coat was taken and placed into a 50 ml tube and 40 ml of a hypochlorous acid (HOCl) solution (Buffer EL from Qiagen) was added. The tube was mixed and placed on ice for 15 minutes. The tube was then centrifuged at 2000×g for 10 minutes at 4° C. The supernatant was decanted and the cell pellet was re-suspended in 10 ml of hypochlorous acid solution (Qiagen Buffer EL). The tube was then centrifuged at 2000×g for 10 minutes at 4° C. The cell pellet was then re-suspended in 20 ml phenol/guanidine thiocyanate solution (TRIZOL from GibcoBRL) for each individual buffy coat that was processed. The mixture was then shredded using a rotary homogenizer. The lysate was then frozen at −80° C. prior to proceeding to RNA isolation.

The arrays were then scanned and analyzed on an Axon Instruments scanner using GenePix 3.0 software. The data presented were derived as follows. First, all features flagged as "not found" by the software were removed from the dataset for individual hybridizations. Second, control features were used to normalize the data for labeling and hybridization variability within the experiment. The control features are cDNA for genes from the plant, *Arabidopsis thaliana*, that were included when spotting the mini-array. Equal amounts of RNA complementary to two of these cDNAs were added to each of the samples before they were labeled. A third was pre-labeled and equal amounts were added to each hybridization solution before hybridization. Using the signal from these genes, we derived a normalization constant ($L_j$) according to the following formula:

$$L_j = \frac{\frac{\sum_{i=1}^{N} BGSS_{j,i}}{N}}{\sum_{j=1}^{K} \frac{\sum_{i=1}^{N} BGSS_{j,i}}{N}}$$

where $BGSS_i$ is the signal for a specific feature as identified in the GenePix software as the median background subtracted signal for that feature, N is the number of *A. thaliana* control features, K is the number of hybridizations, and L is the normalization constant for each individual hybridization. Using the formula above, the mean over all control features of a particular hybridization and dye (e.g. Cy3) was calculated. Then these control feature means for all Cy3 hybridizations were averaged. The control feature mean in one hybridization divided by the average of all hybridizations gives a normalization constant for that particular Cy3 hybridization.

The same normalization steps were performed for Cy3 and Cy5 values, both fluorescence and background. Once normalized, the background Cy3 fluorescence was subtracted from the Cy3 fluorescence for each feature. Values less than 100 were eliminated from further calculations since low values caused spurious results.

Figure 4:
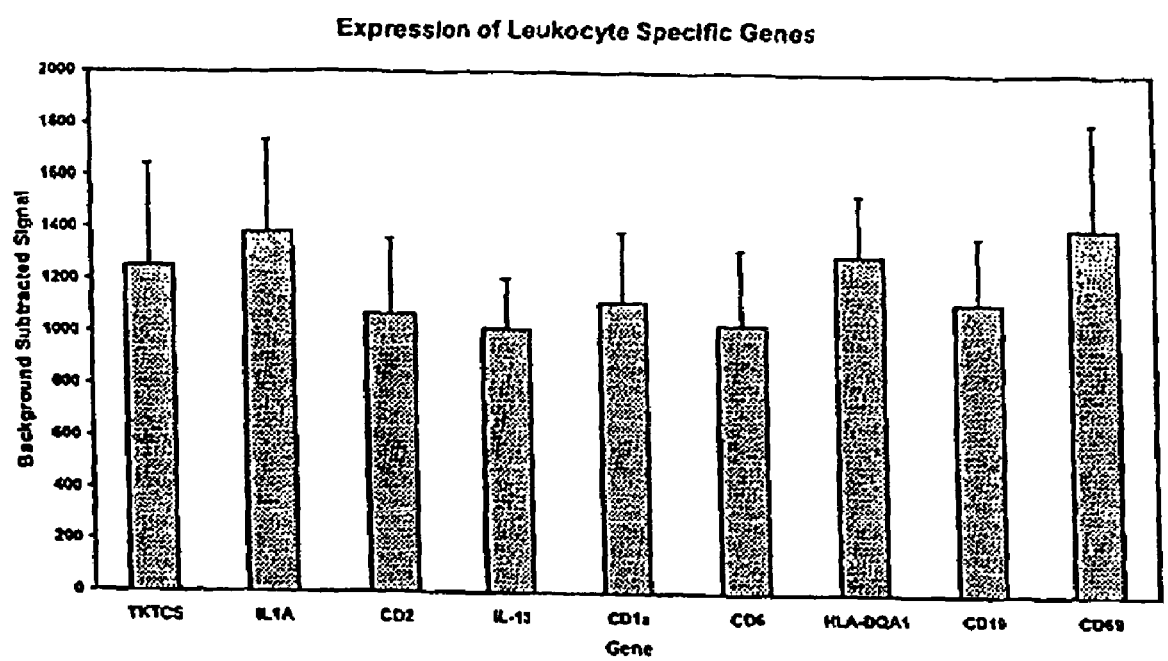
FIG. 4 shows the average background subtracted signal for each of nine leukocyte-specific genes on a mini array. This average is for 3-6 of the above-described hybridizations for each gene. The error bars are the SEM.

FIG. 4 shows the average background subtracted signal for each of nine leukocyte-specific genes on the mini array. This average is for 3-6 of the above-described hybridizations for each gene. The error bars are the SEM.

The ratio of Cy3 to Cy5 signal is shown for a number of genes. This ratio corrects for variability among hybridizations and allows comparison between experiments done at different times. The ratio is calculated as the Cy3 background subtracted signal divided by the Cy5 background subtracted signal. Each bar is the average for 3-6 hybridizations. The error bars are SEM.

Together, these results show that we can measure expression levels for genes that are expressed specifically in subpopulations of leukocytes. These expression measurements were made with only 10 μg of leukocyte total RNA that was labeled directly by reverse transcription. The signal strength can be increased by improved labeling techniques that amplify either the starting RNA or the signal fluorescence. In addition, scanning techniques with higher sensitivity can be used.

Figure 5:
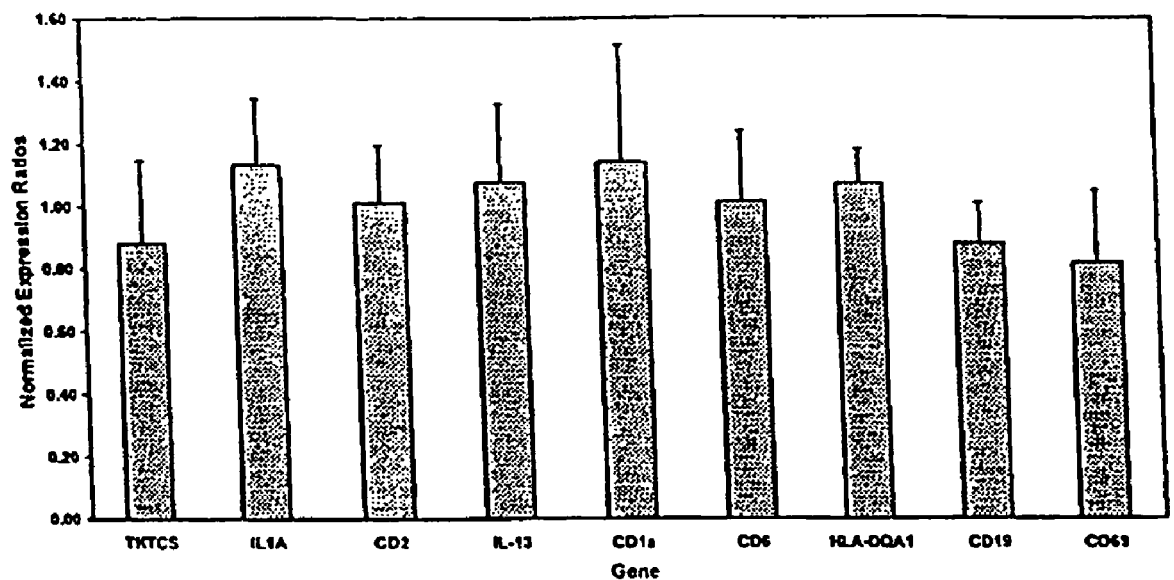
FIG. 5 shows the ratio of Cy3 to Cy5 signal for a number of genes. After normalization, this ratio corrects for variability among hybridizations and allows comparison between experiments done at different times. The ratio is calculated as the Cy3 background subtracted signal divided by the Cy5 background subtracted signal. Each bar is the average for 3-6 hybridizations. The error bars are SEM.
Figure 6:
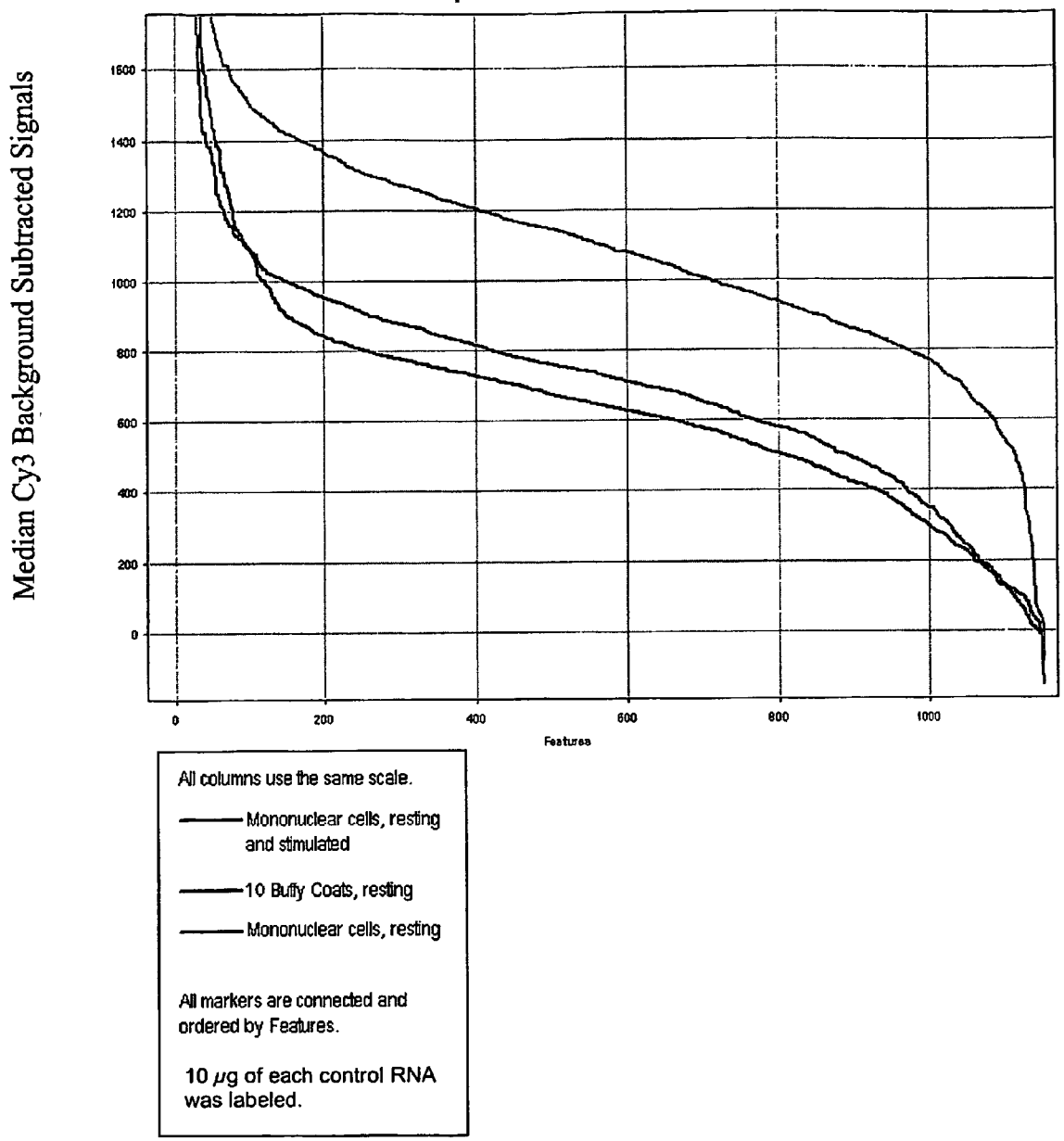
FIG. 6 shows data median Cy3 background subtracted signals for control RNAs using mini arrays.

Genes in FIGS. 4 and 5:

| Gene Name/Description | GenBank Accession Number | Gene Name Abbreviation |
|---|---|---|
| T cell-specific tyrosine kinase Mrna | L10717 | TKTCS |
| Interleukin 1 alpha (IL 1) mRNA, complete cds | NM_000575 | IL1A |
| T-cell surface antigen CD2 (T11) mRNA, complete cds | M14362 | CD2 |
| Interleukin-13 (IL-13) precursor gene, complete cds | U31120 | IL-13 |
| Thymocyte antigen CD1a mRNA, complete cds | M28825 | CD1a |
| CD6 mRNA for T cell glycoprotein CDS | NM_006725 | CD6 |
| MHC class II HLA-DQA1 mRNA, complete cds | U77589 | HLA-DQA1 |
| Granulocyte colony-stimulating factor | M28170 | CD19 |
| Homo sapiens CD69 antigen | NM_001781 | CD69 |

Example 5

Clinical Study to Identify Diagnostic Gene Sets Useful in Diagnosis and Treatment of Cardiac Allograft Recipients An observational study was conducted in which a prospective cohort of cardiac transplant recipients were analyzed for associations between clinical events or rejection grades and expression of a leukocyte candidate nucleotide sequence library. Patients were identified at 4 cardiac transplantation centers while on the transplant waiting list or during their routing post-transplant care. All adult cardiac transplant recipients (new or re-transplants) who received an organ at the study center during the study period or within 3 months of the start of the study period were eligible. The first year after transplantation is the time when most acute rejection occurs and it is thus important to study patients during this period. Patients provided informed consent prior to study procedures.

Peripheral blood leukocyte samples were obtained from all patients at the following time points: prior to transplant surgery (when able), the same day as routinely scheduled screening biopsies, upon evaluation for suspected acute rejection (urgent biopsies), on hospitalization for an acute complication of transplantation or immunosuppression, and when Cytomegalovirus (CMV) infection was suspected or confirmed. Samples were obtained through a standard peripheral vein blood draw or through a catheter placed for patient care (for example, a central venous catheter placed for endocardial biopsy). When blood was drawn from a intravenous line, care was taken to avoid obtaining heparin with the sample as it can interfere with downstream reactions involving the RNA. Mononuclear cells were prepared from whole blood samples as described in Example 2. Samples were processed within 2 hours of the blood draw and DNA and serum were saved in addition to RNA. Samples were stored at −80° C. or on dry ice and sent to the site of RNA preparation in a sealed container with ample dry ice. RNA was isolated from subject samples as described in Example 2 and hybridized to a candidate library of differentially expressed leukocyte nucleotide sequences, as further described in Examples 9-10. Methods used for amplification, labeling, hybridization and scanning are described in Example 11. Analysis of human transplant patient mononuclear cell RNA hybridized to a microarray and identification of diagnostic gene sets is shown in Example 10.

From each patient, clinical information was obtained at the following time points: prior to transplant surgery (when available), the same day as routinely scheduled screening biopsies, upon evaluation for suspected acute rejection (e.g., urgent biopsies), on hospitalization for an acute complication of transplantation or immunosuppression, and when Cytomegalovirus (CMV) infection was suspected or confirmed. Data was collected directly from the patient, from the patient's medical record, from diagnostic test reports or from computerized hospital databases. It was important to collect all information pertaining to the study clinical correlates (diagnoses and patient events and states to which expression data is correlated) and confounding variables (diagnoses and patient events and states that may result in altered leukocyte gene expression. Examples of clinical data collected are: patient sex, date of birth, date of transplant, race, requirement for prospective cross match, occurrence of pre-transplant diagnoses and complications, indication for transplantation, severity and type of heart disease, history of left ventricular assist devices, all known medical diagnoses, blood type, HLA type, viral serologies (including CMV, Hepatitis B and C, HIV and others), serum chemistries, white and red blood cell counts and differentials, CMV infections (clinical manifestations and methods of diagnosis), occurrence of new cancer, hemodynamic parameters measured by catheterization of the right or left heart (measures of graft function), results of echocardiography, results of coronary angiograms, results of intravascular ultrasound studies (diagnosis of transplant vasculopathy), medications, changes in medications, treatments for rejection, and medication levels. Information was also collected regarding the organ donor, including demographics, blood type, HLA type, results of screening cultures, results of viral serologies, primary cause of brain death, the need for inotropic support, and the organ cold ischemia time.

Of great importance was the collection of the results of endocardial biopsy for each of the patients at each visit. Biopsy results were all interpreted and recorded using the international society for heart and lung transplantation (ISHLT) criteria, described below. Biopsy pathological grades were determined by experienced pathologists at each center.

ISHLT Criteria

| Grade | Finding | Rejection Severity |
|---|---|---|
| 0 | No lymphocytic infiltrates | None |
| 1A | Focal (perivascular or interstitial lymphocytic infiltrates without necrosis) | Borderline mild |
| 1B | Diffuse but sparse lymphocytic infiltrates without necrosis | Mild |
| 2 | One focus only with aggressive lymphocytic infiltrate and/or myocyte damage | Mild, focal moderate |
| 3A | Multifocal aggressive lymphocytic infiltrates and/or myocardial damage | Moderate |
| 3B | Diffuse inflammatory lymphocytic infiltrates with necrosis | Borderline Severe |

-continued

| Grade | Finding | Rejection Severity |
|---|---|---|
| 4 | Diffuse aggressive polymorphous lymphocytic infiltrates with edema hemorrhage and vasculitis, with necrosis | Severe |

Because variability exists in the assignment of ISHLT grades, it was important to have a centralized and blinded reading of the biopsy slides by a single pathologist. This was arranged for all biopsy slides associated with samples in the analysis. Slides were obtained and assigned an encoded number. A single pathologist then read all slides from all centers and assigned an ISHLT grade. Grades from the single pathologist were then compared to the original grades derived from the pathologists at the study centers. For the purposes of correlation analysis of leukocyte gene expression to biopsy grades, the centralized reading information was used in a variety of ways (see Example 10 for more detail). In some analyses, only the original reading was used as an outcome. In other analyses, the result from the centralized reader was used as an outcome. In other analyses, the highest of the 2 grades was used. For example, if the original assigned grade was 0 and the centralized reader assigned a 1A, then 1A was the grade used as an outcome. In some analyses, the highest grade was used and then samples associated with a Grade 1A reading were excluded from the analysis. In some analyses, only grades with no disagreement between the 2 readings were used as outcomes for correlation analysis. Clinical data was entered and stored in a database. The database was queried to identify all patients and patient visits that meet desired criteria (for example, patients with >grade II biopsy results, no CMV infection and time since transplant <12 weeks).

The collected clinical data (disease criteria) is used to define patient or sample groups for correlation of expression data. Patient groups are identified for comparison, for example, a patient group that possesses a useful or interesting clinical distinction, versus a patient group that does not possess the distinction. Examples of useful and interesting patient distinctions that can be made on the basis of collected clinical data are listed here:

1. Rejection episode of at least moderate histologic grade, which results in treatment of the patient with additional corticosteroids, anti-T cell antibodies, or total lymphoid irradiation.

2. Rejection with histologic grade 2 or higher.

3. Rejection with histologic grade <2.

4. The absence of histologic rejection and normal or unchanged allograft function (based on hemodynamic measurements from catheterization or on echocardiographic data).

5. The presence of severe allograft dysfunction or worsening allograft dysfunction during the study period (based on hemodynamic measurements from catheterization or on echocardiographic data).

6. Documented CMV infection by culture, histology, or PCR, and at least one clinical sign or symptom of infection.

7. Specific graft biopsy rejection grades

8. Rejection of mild to moderate histologic severity prompting augmentation of the patient's chronic immunosuppressive regimen 9. Rejection of mild to moderate severity with allograft dysfunction prompting plasmaphoresis or a diagnosis of "humoral" rejection 10. Infections other than CMV, esp. Epstein Barr virus (EBV)

11. Lymphoproliferative disorder (also called, post-transplant lymphoma)

12. Transplant vasculopathy diagnosed by increased intimal thickness on intravascular ultrasound (IVUS), angiography, or acute myocardial infarction.

13. Graft Failure or Retransplantation

14. All cause mortality

15. Grade 1A or higher rejection as defined by the initial biopsy reading.

16. Grade 1B or higher rejection as defined by the initial biopsy reading.

17. Grade 1A or higher rejection as defined by the centralized biopsy reading.

18. Grade 1B or higher rejection as defined by the centralized biopsy reading.

19. Grade 1A or higher rejection as defined by the highest of the initial and centralized biopsy reading.

20. Grade 1B or higher rejection as defined by the highest of the initial and centralized biopsy reading.

21. Any rejection >Grade 2 occurring in patient at any time in the post-transplant course.

Expression profiles of subject samples are examined to discover sets of nucleotide sequences with differential expression between patient groups, for example, by methods describes above and below. Non-limiting examples of patient leukocyte samples to obtain for discovery of various diagnostic nucleotide sets are as follows:

Leukocyte set to avoid biopsy or select for biopsy:

Samples: Grade 0 vs. Grades 1-4

Leukocyte set to monitor therapeutic response:

Examine successful vs. unsuccessful drug treatment.

Samples:

Successful: Time 1: rejection, Time 2: drug therapy Time 3: no rejection
   Unsuccessful: Time 1: rejection, Time 2: drug therapy; Time 3: rejection Leukocyte set to predict subsequent acute rejection.

Biopsy may show no rejection, but the patient may develop rejection shortly thereafter. Look at profiles of patients who subsequently do and do not develop rejection.

Samples:

Group 1 (Subsequent rejection): Time 1: Grade 0; Time 2: Grade>0

Group 2 (No subsequent rejection): Time 1: Grade 0; Time 2: Grade 0

Focal rejection may be missed by biopsy. When this occurs the patient may have a Grade 0, but actually has rejection. These patients may go on to have damage to the graft etc.

Samples:

Non-rejectors: no rejection over some period of time

Rejectors: an episode of rejection over same period

Leukocyte set to diagnose subsequent or current graft failure:

Samples:

Echocardiographic or catheterization data to define worsening function over time and correlate to profiles.

Leukocyte set to diagnose impending active CMV:

Samples:

Look at patients who are CMV IgG positive. Compare patients with subsequent (to a sample) clinical CMV infection verses no subsequent clinical CMV infection.

Leukocyte set to diagnose current active CMV:

Samples:

Analyze patients who are CMV IgG positive. Compare patients with active current clinical CMV infection vs. no active current CMV infection.

Upon identification of a nucleotide sequence or set of nucleotide sequences that distinguish patient groups with a high degree of accuracy, that nucleotide sequence or set of nucleotide sequences is validated, and implemented as a diagnostic test. The use of the test depends on the patient groups that are used to discover the nucleotide set. For example, if a set of nucleotide sequences is discovered that have collective expression behavior that reliably distinguishes patients with no histological rejection or graft dysfunction from all others, a diagnostic is developed that is used to screen patients for the need for biopsy. Patients identified as having no rejection do not need biopsy, while others are subjected to a biopsy to further define the extent of disease. In another example, a diagnostic nucleotide set that determines continuing graft rejection associated with myocyte necrosis (>grade I) is used to determine that a patient is not receiving adequate treatment under the current treatment regimen. After increased or altered immunosuppressive therapy, diagnostic profiling is conducted to determine whether continuing graft rejection is progressing. In yet another example, a diagnostic nucleotide set(s) that determine a patient's rejection status and diagnose cytomegalovirus infection is used to balance immunosuppressive and anti-viral therapy.

The methods of this example are also applicable to cardiac xenograft monitoring.

Example 6

Identification of Diagnostic Nucleotide Sets for Kidney and Liver Allograft Rejection Diagnostic tests for rejection are identified using patient leukocyte expression profiles to identify a molecular signature correlated with rejection of a transplanted kidney or liver.

Blood, or other leukocyte source, samples are obtained from patients undergoing kidney or liver biopsy following liver or kidney transplantation, respectively. Such results reveal the histological grade, i.e., the state and severity of allograft rejection. Expression profiles are obtained from the samples as described above, and the expression profile is correlated with biopsy results. In the case of kidney rejection, clinical data is collected corresponding to urine output, level of creatine clearance, and level of serum creatine (and other markers of renal function). Clinical data collected for monitoring liver transplant rejection includes, biochemical characterization of serum markers of liver damage and function such as SGOT, SGPT, Alkaline phosphatase, GGT, Bilirubin, Albumin and Prothrombin time.

Leukocyte nucleotide sequence expression profiles are collected and correlated with important clinical states and outcomes in renal or hepatic transplantation. Examples of useful clinical correlates are given here:

1. Rejection episode of at least moderate histologic grade, which results in treatment of the patient with additional corticosteroids, anti-T cell antibodies, or total lymphoid irradiation.

2. The absence of histologic rejection and normal or unchanged allograft function (based on tests of renal or liver function listed above).

3. The presence of severe allograft dysfunction or worsening allograft dysfunction during the study period (based on tests of renal and hepatic function listed above).

4. Documented CMV infection by culture, histology, or PCR, and at least one clinical sign or symptom of infection.

5. Specific graft biopsy rejection grades

6. Rejection of mild to moderate histologic severity prompting augmentation of the patient's chronic immunosuppressive regimen 7. Infections other than CMV, esp. Epstein Barr virus (EBV)

8. Lymphoproliferative disorder (also called, post-transplant lymphoma)

9. Graft Failure or Retransplantation

10. Need for hemodialysis or other renal replacement therapy for renal transplant patients.

11. Hepatic encephalopathy for liver transplant recipients.

12. All cause mortality

Subsets of the candidate library (or of a previously identified diagnostic nucleotide set), are identified, according to the above procedures, that have predictive and/or diagnostic value for kidney or liver allograft rejection.

Example 7

Identification of a Diagnostic Nucleotide Set for Diagnosis of Cytomegalovirus

Cytomegalovirus is a very important cause of disease in immunocompromised patients, for example, transplant patients, cancer patients, and AIDS patients. The virus can cause inflammation and disease in almost any tissue (particularly the colon, lung, bone marrow and retina). It is increasingly important to identify patients with current or impending clinical CMV disease, particularly when immunosuppressive drugs are to be used in a patient, e.g. for preventing transplant rejection. Leukocytes are profiled in patients with active CMV, impending CMV, or no CMV. Expression profiles correlating with diagnosis of active or impending CMV are identified. Subsets of the candidate library (or a previously identified diagnostic nucleotide set) are identified, according to the above procedures that have predictive value for the diagnosis of active or impending CMV. Diagnostic nucleotide set(s) identified with predictive value for the diagnosis of active or impending CMV may be combined, or used in conjunction with, cardiac, liver and/or kidney allograft-related diagnostic gene set(s) (described in Examples 6 and 10).

In addition, or alternatively, CMV nucleotide sequences are obtained, and a diagnostic nucleotide set is designed using CMV nucleotide sequence. The entire sequence of the organism is known and all CMV nucleotide sequences can be isolated and added to the library using the sequence information and the approach described below. Known expressed genes are preferred. Alternatively, nucleotide sequences are selected to represent groups of CMV genes that are coordinately expressed (immediate early genes, early genes, and late genes) (Spector et al. 1990, Stamminger et al. 1990).

Oligonucleotides were designed for CMV genes using the oligo design procedures of Example 8. Probes were designed using the 14 gene sequences shown here and were included on the array described in example 9:

| | | |
|---|---|---|
| Cytomega- | HCMVTRL2 (IRL2) | 1893 ... 2240 |
| lovirus | HCMVTRL7 (IRL7) | complement(6595 ... 6843) |
| (CMV) | HCMVUL21 | complement(26497 ... 27024) |
| Accession | HCMVUL27 | complement(32831 ... 34657) |
| #X17403 | HCMVUL33 | 43251 ... 44423 |
| | HCMVUL54 | complement(76903 ... 80631) |
| | HCMVUL75 | complement(107901 ... 110132) |
| | HCMVUL83 | complement(119352 ... 121037) |
| | HCMVUL106 | complement(154947 ... 155324) |
| | HCMVUL109 | complement(157514 ... 157810) |
| | HCMVUL113 | 161503 ... 162800 |
| | HCMVUL122 | complement(169364 ... 170599) |
| | HCMVUL123 (last exon at 3'-end) | complement(171006 ... 172225) |
| | HCMVUS28 | 219200 ... 220171 |

Diagnostic nucleotide set(s) for expression of CMV genes is used in combination with diagnostic leukocyte nucleotide sets for diagnosis of other conditions, e.g. organ allograft rejection.

Using the techniques described in example 2 mononuclear samples from 180 cardiac transplant recipients (enrolled in the study described in Example 5) were used for expression profiling with the leukocyte arrays. Of these samples 15 were associated with patients who had a diagnosis of primary or reactivation CMV made by culture, PCR or any specific diagnostic test.

After preparation of RNA, amplification, labeling, hybridization, scanning, feature extraction and data processing were done as described in Example 11 using the oligonucleotide microarrays described in Example 9.

The resulting log ratio of expression of Cy3 (patient sample)/Cy5 (R50 reference RNA) was used for analysis. Significance analysis for microarrays (SAM, Tusher 2001, see Example 15) was applied to determine which genes were most significantly differentially expressed between these 15 CMV patients and the 165 non-CMV patients (Table 12). 12 genes were identified with a 0% FDR and 6 with a 0.1% FDR and are listed in Table 2. Some genes are represented by more than one oligonucleotide on the array and for 2 genes, multiple oligonucleotides from the same gene are called significant (SEQ IDs: 3061, 3064: eomesodermin and 3031, 3040, 104, 2736: small inducible cytokine A4).

Clinical variables were also included in the significance analysis. For example, the white blood cell count and the number of weeks post transplant (for the patient at the time the sample was obtained) were available for most of the 180 samples. The log of these variables was taken and the variables were then used in the significance analysis described above with the gene expression data. Both the white blood cell count (0.1% FDR) and the weeks post transplant (0% FDR) appeared to correlate with CMV status. CMV patients were more likely to have samples associated with later post transplant data and the lower white blood cell counts.

These genes and variables can be used alone or in association with other genes or variables or with other genes to build a diagnostic gene set or a classification algorithm using the approaches described herein.

Primers for real-time PCR validation were designed for some of these genes as described in Example 13 and listed in Table 2C and the sequence listing. Using the methods described in example 13, primers for Granzyme B were designed and used to validate expression findings from the arrays. 6 samples were tested (3 from patients with CMV and 3 from patients without CMV). The gene was found to be differentially expressed between the patients with and without CMV (see example 13 for full description). This same approach can be used to validate other diagnostic genes by real-time PCR. Diagnostic nucleotide sets can also be identified for a variety of other viral diseases (Table 1) using this same approach.

cDNA microarrays may be used to monitor viral expression. In addition, these methods may be used to monitor other viruses, such as Epstein-Barr virus, Herpes Simplex 1 and vesicular stomatitis virus.

Example 8

Design of Oligonucleotide Probes

By way of example, this section describes the design of four oligonucleotide probes using Array Designer Ver 1.1 (Premier Biosoft International, Palo Alto, Calif.). The major steps in the process are given first.

Obtain best possible sequence of mRNA from GenBank. If a full-length sequence reference sequence is not available, a partial sequence is used, with preference for the 3' end over the 5' end. When the sequence is known to represent the antisense strand, the reverse complement of the sequence is used for probe design. For sequences represented in the subtracted leukocyte expression library that have no significant match in GenBank at the time of probe design, our sequence is used.

Mask low complexity regions and repetitive elements in the sequence using an algorithm such as RepeatMasker.

Use probe design software, such as Array Designer, version 1.1, to select a sequence of 50 residues with specified physical and chemical properties. The 50 residues nearest the 3' end constitute a search frame. The residues it contains are tested for suitability. If they don't meet the specified criteria, the search frame is moved one residue closer to the 5' end, and the 50 residues it now contains are tested. The process is repeated until a suitable 50-mer is found.

If no such 50-mer occurs in the sequence, the physical and chemical criteria are adjusted until a suitable 50-mer is found.

Compare the probe to dbEST, the UniGene cluster set, and the assembled human genome using the BLASTn search tool at NCBI to obtain the pertinent identifying information and to verify that the probe does not have significant similarity to more than one known gene.

Clone 40H12

Clone 40H12 was sequenced and compared to the nr, dbEST, and UniGene databases at NCBI using the BLAST search tool. The sequence matched accession number NM 002310, a 'curated RefSeq project' sequence, see Pruitt et al. (2000) Trends Genet. 16:44-47, encoding leukemia inhibitory factor receptor (LIFR) mRNA with a reported E value of zero. An E value of zero indicates there is, for all practical purposes, no chance that the similarity was random based on the length of the sequence and the composition and size of the database. This sequence, cataloged by accession number NM_002310, is much longer than the sequence of clone 40H12 and has a poly-A tail. This indicated that the sequence cataloged by accession number NM_002310 is the sense strand and a more complete representation of the mRNA than the sequence of clone 40H12, especially at the 3' end. Accession number "NM_002310" was included in a text file of accession numbers representing sense strand mRNAs, and sequences for the sense strand mRNAs were obtained by uploading a text file containing desired accession numbers as an Entrez search query using the Batch Entrez web interface and saving the results locally as a FASTA file. The following sequence was obtained, and the region of alignment of clone 40H12 is outlined:

```
CTCTCTCCCAGAACGTGTCTCTGCTGCAAGGCACCGGGCCCTTTCGCTCTGCAGAACTGCACTTGCAAGA

CCATTATCAACTCCTAATCCCAGCTCAGAAAGGGAGCCTCTGCGACTCATTCATCGCCCTCCAGGACTGA

CTGCATTGCACAGATGATGGATATTTACGTATGTTTGAAACGACCATCCTGGATGGTGGACAATAAAAGA

ATGAGGACTGCTTCAAATTTCCAGTGGCTGTTATCAACATTTATTCTTCTATATCTAATGAATCAAGTAA

ATAGCCAGAAAAAGGGGGCTCCTCATGATTTGAAGTGTGTAACTAACAATTTGCAAGTGTGGAACTGTTC

TTGGAAAGCACCCTCTGGAACAGGCCGTGGTACTGATTATGAAGTTTGCATTGAAAACAGGTCCCGTTCT

TGTTATCAGTTGGAGAAAACCAGTATTAAAATTCCAGCTCTTTCACATGGTGATTATGAAATAACAATAA

ATTCTCTACATGATTTTGGAAGTTCTACAAGTAAATTCACACTAAATGAACAAAACGTTTCCTTAATTCC

AGATACTCCAGAGATCTTGAATTTGTCTGCTGATTTCTCAACCTCTACATTATACCTAAAGTGGAACGAC

AGGGGTTCAGTTTTTCCACACCGCTCAAATGTTATCTGGGAAATTAAAGTTCTACGTAAAGAGAGTATGG
```

```
AGCTCGTAAAATTAGTGACCCACAACACAACTCTGAATGGCAAAGATACACTTCATCACTGGAGTTGGGC
CTCAGATATGCCCTTGGAATGTGCCATTCATTTTGTGGAAATTAGATGCTACATTGACAATCTTCATTTT
TCTGGTCTCGAAGAGTGGAGTGACTGGAGCCCTGTGAAGAACATTTCTTGGATACCTGATTCTCAGACTA
AGGTTTTTCCTCAAGATAAAGTGATACTTGTAGGCTCAGACATAACATTTTGTTGTGTGAGTCAAGAAAA
AGTGTTATCAGCACTGATTGGCCATACAAACTGCCCCTTGATCCATCTTGATGGGGAAAATGTTGCAATC
AAGATTCGTAATATTTCTGTTTCTGCAAGTAGTGGAACAAATGTAGTTTTTACAACCGAAGATAACATAT
TTGGAACCGTTATTTTTGCTGGATATCCACCAGATACTCCTCAACAACTGAATTGTGAGACACATGATTT
AAAAGAAATTATATGTAGTTGGAATCCAGGAAGGGTGACAGCGTTGGTGGGCCCACGTGCTACAAGCTAC
ACTTTAGTTGAAAGTTTTTCAGGAAAATATGTTAGACTTAAAAGAGCTGAAGCACCTACAAACGAAAGCT
ATCAATTATTATTTCAAATGCTTCCAAATCAAGAAATATATAATTTTACTTTGAATGCTCACAATCCGCT
GGGTCGATCACAATCAACAATTTTAGTTAATATAACTGAAAAAGTTTATCCCCATACTCCTACTTCATTC
AAAGTGAAGGATATTAATTCAACAGCTGTTAAACTTTCTTGGCATTTACCAGGCAACTTTGCAAAGATTA
ATTTTTATGTGAAATTGAAATTAAGAAATCTAATTCAGTACAAGAGCAGCGGAATGTCACAATCAAAGG
AGTAGAAAATTCAAGTTATCTTGTTGCTCTGGACAAGTTAAATCCATACACTCTATATACTTTTCGGATT
CGTTGTTCTACTGAAACTTTCTGGAAATGGAGCAAATGGAGCAATAAAAAACAACATTTAACAACAGAAG
CCAGTCCTTCAAAGGGGCCTGATACTTGGAGAGAGTGGAGTTCTGATGGAAAAAATTTAATAATCTATTG
GAAGCCTTTACCCATTAATGAAGCTAATGGAAAAATACTTTCCTACAATGTATCGTGTTCATCAGATGAG
GAAACACAGTCCCTTTCTGAAATCCCTGATCCTCAGCACAAAGCAGAGATACGACTTGATAAGAATGACT
ACATCATCAGCGTAGTGGCTAAAAATTCTGTGGGCTCATCACCACCTTCCAAAATAGCGAGTATGGAAAT
TCCAAATGATGATCTCAAAATAGAACAAGTTGTTGGGATGGGAAAGGGGATTCTCCTCACCTGGCATTAC
GACCCCAACATGACTTGCGACTACGTCATTAAGTGGTGTAACTCGTCTCGGTCGGAACCATGCCTTATGG
ACTGGAGAAAAGTTCCCTCAAACAGCACTGAAACTGTAATAGAATCTGATGAGTTTCGACCAGGTATAAG
ATATAATTTTTTCCTGTATGGATGCAGAAATCAAGGATATCAATTATTACGCTCCATGATTGGATATATA
GAAGAATTGGCTCCCATTGTTGCACCAAATTTTACTGTTGAGGATACTTCTGCAGATTCGATATTAGTAA
AATGGGAAGACATTCCTGTGGAAGAACTTAGAGGCTTTTTAAGAGGATATTTGTTTTACTTTGGAAAAGG
AGAAAGAGACACATCTAAGATGAGGGTTTTAGAATCAGGTCGTTCTGACATAAAAGTTAAGAATATTACT
GACATATCCCAGAAGACACTGAGAATTGCTGATCTTCAAGGTAAAACAAGTTACCACCTGGTCTTGCGAG
CCTATACAGATGGTGGAGTGGGCCCGGAGAAGAGTATGTATGTGGTGACAAAGGAAAATTCTGTGGGATT
AATTATTGCCATTCTCATCCCAGTGGCAGTGGCTGTCATTGTTGGAGTGGTGACAAGTATCCTTTGCTAT
CGGAAACGAGAATGGATTAAAGAAACCTTCTACCCTGATATTCCAAATCCAGAAAACTGTAAAGCATTAC
AGTTTCAAAAGAGTGTCTGTGAGGGAAGCAGTGCTCTTAAAACATTGGAAATGAATCCTTGTACCCCAAA
TAATGTTGAGGTTCTGGAAACTCGATCAGCATTTCCTAAAATAGAAGATACAGAAATAATTTCCCCAGTA
GCTGAGCGTCCTGAAGATCGCTCTGATGCAGAGCCTGAAAACCATGTGGTTGTGTCCTATTGTCCACCCA
TCATTGAGGAAGAAATACCAAACCCAGCCGCAGATGAAGCTGGAGGGACTGCACAGGTTATTTACATTGA
TGTTCAGTCGATGTATCAGCCTCAAGCAAAACCAGAAGAAGAACAAGAAAATGACCCTGTAGGAGGGGCA
GGCTATAAGCCACAGATGCACCTCCCCATTAATTCTACTGTGGAAGATATAGCTGCAGAAGAGGACTTAG
ATAAAACTGCGGGTTACAGACCTCAGGCCAATGTAAATACATGGAATTTAGTGTCTCCAGACTCTCCTAG
ATCCATAGACAGCAACAGTGAGATTGTCTCATTTGGAAGTCCATGCTCCATTAATTCCCGACAATTTTTG
ATTCCTCCTAAAGATGAAGACTCTCCTAAATCTAATGGAGGAGGGTGGTCCTTTACAAACTTTTTTCAGA
```

ACAAACCAAACGATTAACAGTGTCACCGTGTCACTTCAGTCAGCCATCTCAATAAGCTCTTACTGCTAGT

GTTGCTACATCAGCACTGGGCATTCTTGGAGGGATCCTGTGAAGTATTGTTAGGAGGTGAACTTCACTAC

ATGTTAAGTTACACTGAAAGTTCATGTGCTTTTAATGTAGTCTAAAAGCCAAAGTATAGTGACTCAGAAT

CCTCAATCCACAAAACTCAAGATTGGGAGCTCTTTGTGATCAAGCCAAAGAATTCTCATGTACTCTACCT

TCAAGAAGCATTTCAAGGCTAATACCTACTTGTACGTACATGTAAAACAAATCCCGCCGCAACTGTTTTC

TGTTCTGTTGTTTGTGGTTTTCTCATATGTATACTTGGTGGAATTGTAAGTGGATTTGCAGGCCAGGGAG

AAAATGTCCAAGTAACAGGTGAAGTTTATTTGCCTGACGTTTACTCCTTTCTAGATGAAAACCAAGCACA

GATTTTAAAACTTCTAAGATTATTCTCCTCTATCCACAGCATTCACAAAAATTAATATAATTTTTAATGT

AGTGACAGCGATTTAGTGTTTTGTTTGATAAAGTATGCTTATTTCTGTGCCTACTGTATAATGGTTATCA

AACAGTTGTCTCAGGGGTACAAACTTTGAAAACAAGTGTGACACTGACCAGCCCAAATCATAATCATGTT

TTCTTGCTGTGATAGGTTTTGCTTGCCTTTTCATTATTTTTTAGCTTTATGCTTGCTTCCATTATTTCA

GTTGGTTGCCCTAATATTTAAAATTTACACTTCTAAGACTAGAGACCCACATTTTTTAAAAATCATTTTA

TTTTGTGATACAGTGACAGCTTTATATGAGCAAATTCAATATTATTCATAAGCATGTAATTCCAGTGACT

TACTATGTGAGATGACTACTAAGCAATATCTAGCAGCGTTAGTTCCATATAGTTCTGATTGGATTTCGTT

CCTCCTGAGGAGACCATGCCGTTGAGCTTGGCTACCCAGGCAGTGGTGATCTTTGACACCTTCTGGTGGA

TGTTCCTCCCACTCATGAGTCTTTTCATCATGCCACATTATCTGATCCAGTCCTCACATTTTTAAATATA

AAACTAAAGAGAGAATGCTTCTTACAGGAACAGTTACCCAAGGGCTGTTTCTTAGTAACTGTCATAAACT

GATCTGGATCCATGGGCATACCTGTGTTCGAGGTGCAGCAATTGCTTGGTGAGCTGTGCAGAATTGATTG

CCTTCAGCACAGCATCCTCTGCCCACCCTTGTTTCTCATAAGCGATGTCTGGAGTGATTGTGGTTCTTGG

AAAAGCAGAAGGAAAAACTAAAAAGTGTATCTTGTATTTTCCCTGCCCTCAGGTTGCCTATGTATTTTAC

CTTTTCATATTTAAGGCAAAAGTACTTGAAAATTTTAATTGTCCGAATAAGATATGTCTTTTTTGTTTGT

TTTTTTTGGTTGGTTGTTTGTTTTTTATCATCTGAGATTCTGTAATGTATTTGCAAATAATGGATCAATT

AATTTTTTTTGAAGCTCATATTGTATCTTTTTAAAAACCATGTTGTGGAAAAAAAGCCAGAGTGACAATG

ACAAAATCTATTTAGGAACTCTGTGTATGAATCCTGATTTTAACTGCTAGGATTCAGCTAAATTTCTGAG

CTTTATGATCTGTGGAAATTTGGAATGAAATCGAATTCATTTTGTACATACATAGTATATTAAAACTATA

TAATAGTTCATAGAAATGTTCAGTAATGAAAAAATATATCCAATCAGAGCCATCCCGAAAAAAAAAAAAA

AA (SEQ ID NO: 3101)

The FASTA file, including the sequence of NM_002310, was masked using the RepeatMasker web interface (Smit, A F A & Green, P RepeatMasker at http://ftp.genome.washington.edu/RM/RepeatMasker.html, Smit and Green). Specifically, during masking, the following types of sequences were replaced with "N's": SINE/MIR & LINE/L2, LINE/L1, LTR/MaLR, LTR/Retroviral, Alu, and other low informational content sequences such as simple repeats. Below is the sequence following masking:

```
CTCTCTCCCAGAACGTGTCTCTGCTGCAAGGCACCGGGCCCTTTCGCTCTGCAGAACTGCACTTGCAAG
ACCATTATCAACTCCTAATCCCAGCTCAGAAAGGGAGCCTCTGCGACTCATTCATCGCCCTCCAGGACT
GACTGCATTGCACAGATGATGGATATTTACGTATGTTTGAAACGACCATCCTGGATGGTGGACAATAAA
AGAATGAGGACTGCTTCAAATTTCCAGTGGCTGTTATCAACATTTATTCTTCTATATCTAATGAATCAA
GTAAATAGCCAGAAAAAGGGGGCTCCTCATGATTTGAAGTGTGTAACTAACAATTTGCAAGTGTGGAAC
TGTTCTTGGAAAGCACCCTCTGGAACAGGCCGTGGTACTGATTATGAAGTTTGCATTGAAAACAGGTCC
CGTTCTTGTTATCAGTTGGAGAAAACCAGTATTAAAATTCCAGCTCTTTCACATGGTGATTATGAAATA
ACAATAAATTCTCTACATGATTTTGGAAGTTCTACAAGTAAATTCACACTAAATGAACAAAACGTTTCC
TTAATTCCAGATACTCCAGAGATCTTGAATTTGTCTGCTGATTTCTCAACCTCTACATTATACCTAAAG
TGGAACGACAGGGGTTCAGTTTTTCCACACCGCTCAAATGTTATCTGGGAAATTAAAGTTCTACGTAAA
GAGAGTATGGAGCTCGTAAAATTAGTGACCCACAACACAACTCTGAATGCCAAAGATACACTTCATCAC
TGGAGTTGGGCCTCAGATATGCCCTTGGAATGTGCCATTCATTTTGTGGAAATTAGATGCTACATTGAC
AATCTTCATTTTTCTGGTCTCGAAGAGTGGAGTGACTGGAGCCCTGTGAAGAACATTTCTTGGATACCT
GATTCTCAGACTAAGGTTTTTCCTCAAGATAAAGTGATACTTGTAGGCTCAGACATAACATTTTGTTGT
GTGAGTCAAGAAAAAGTGTTATCAGCACTGATTGGCCATACAAACTGCCCCTTGATCCATCTTGATGGG
GAAAATGTTGCAATCAAGATTCGTAATATTTCTGTTTCTGCAAGTAGTGGAACAAATGTAGTTTTTACA
ACCGAAGATAACATATTTGGAACCGTTATTTTTGCTGGATATCCACCAGATACTCCTCAACAACTGAAT
TGTGAGACACATGATTTAAAAGAAATTATATGTAGTTGGAATCCAGGAAGGGTGACAGCGTTGGTGGGC
CCACGTGCTACAAGCTACACTTTAGTTGAAAGTTTTTCAGGAAAATATGTTAGACTTAAAAGAGCTGAA
GCACCTACAAACGAAAGCTATCAATTATTATTTCAAATGCTTCCAAATCAAGAAATATATAATTTTACT
TTGAATGCTCACAATCCGCTGGGTCGATCACAATCAACAATTTTAGTTAATATAACTGAAAAAGTTTAT
CCCCATACTCCTACTTCATTCAAAGTGAAGGATATTAATTCAACAGCTGTTAAACTTTCTTGGCATTTA
CCAGGCAACTTTGCAAAGATTAATTTTTTATGTGAAATTGAAATTAAGAAATCTAATTCAGTACAAGAG
CAGCGGAATGTCACAATCAAAGGAGTAGAAAATTCAAGTTATCTTGTTGCTCTGGACAAGTTAAATCCA
TACACTCTATATACTTTTCGGATTCGTTGTTCTACTGAAACTTTCTGGAAATGGAGCAAATGGAGCAAT
AAAAAACAACATTTAACAACAGAAGCCAGTCCTTCAAAGGGGCCTGATACTTGGAGAGAGTGGAGTTCT
GATGGAAAAAATTTAATAATCTATTGGAAGCCTTTACCCATTAATGAAGCTAATGGAAAAATACTTTCC
TACAATGTATCGTGTTCATCAGATGAGGAAACACAGTCCCTTTCTGAAATCCCTGATCCTCAGCACAAA
GCAGAGATACGACTTGATAAGAATGACTACATCATCAGCGTAGTGGCTAAAAATTCTGTGGGCTCATCA
CCACCTTCCAAAATAGCGAGTATGGAAATTCCAAATGATGATCTCAAAATAGAACAAGTTGTTGGGATG
GGAAAGGGGATTCTCCTCACCTGGCATTACGACCCCAACATGACTTGCGACTACGTCATTAAGTGGTGT
AACTCGTCTCGGTCGGAACCATGCCTTATGGACTGGAGAAAAGTTCCCTCAAACAGCACTGAAACTGTA
ATAGAATCTGATGAGTTTCGACCAGGTATAAGATATAATTTTTTCCTGTATGGATGCAGAAATCAAGGA
TATCAATTATTACGCTCCATGATTGGATATATAGAAGAATTGGCTCCCATTGTTGCACCAAATTTACT
GTTGAGGATACTTCTGCAGATTCGATATTAGTAAAATGGGAAGACATTCCTGTGGAAGAACTTAGAGGC
TTTTTAAGAGGATATTTGTTTTACTTTGGAAAAGGAGAAAGAGACACATCTAAGATGAGGGTTTTAGAA
```

```
TCAGGTCGTTCTGACATAAAAGTTAAGAATATTACTGACATATCCCAGAAGACACTGAGAATTGCTGAT
CTTCAAGGTAAAACAAGTTACCACCTGGTCTTGCGAGCCTATACAGATGGTGGAGTGGGCCCGGAGAAG
AGTATGTATGTGGTGACAAAGGAAAATTCTGTGGGATTAATTATTGCCATTCTCATCCCAGTGGCAGTG
GCTGTCATTGTTGGAGTGGTGACAAGTATCCTTTGCTATCGGAAACGAGAATGGATTAAAGAAACCTTC
TACCCTGATATTCCAAATCCAGAAAACTGTAAAGCATTACAGTTTCAAAAGAGTGTCTGTGAGGGAAGC
AGTGCTCTTAAAACATTGGAAATGAATCCTTGTACCCCAAATAATGTTGAGGTTCTGGAAACTCGATCA
GCATTTCCTAAAATAGAAGATACAGAAATAATTTCCCCAGTAGCTGAGCGTCCTGAAGATCGCTCTGAT
GCAGAGCCTGAAAACCATGTGGTTGTGTCCTATTGTCCACCCATCATTGAGGAAGAAATACCAAACCCA
GCCGCAGATGAAGCTGGAGGGACTGCACAGGTTATTTACATTGATGTTCAGTCGATGTATCAGCCTCAA
GCAAAACCAGAAGAAGAACAAGAAAATGACCCTGTAGGAGGGGCAGGCTATAAGCCACAGATGCACCTC
CCCATTAATTCTACTGTGGAAGATATAGCTGCAGAAGAGGACTTAGATAAAACTGCGGGTTACAGACCT
CAGGCCAATGTAAATACATGGAATTTAGTGTCTCCAGACTCTCCTAGATCCATAGACAGCAACAGTGAG
ATTGTCTCATTTGGAAGTCCATGCTCCATTAATTCCCGACAATTTTTTGATTCCTCCTAAAGATGAAGAC
TCTCCTAAATCTAATGGAGGAGGGTGGTCCTTTACAAACTTTTTTCAGAACAAACCAAACGATTAACAG
TGTCACCGTGTCACTTCAGTCAGCCATCTCAATAAGCTCTTACTGCTAGTGTTGCTACATCAGCACTGG
GCATTCTTGGAGGGATCCTGTGAAGTATTGTTAGGAGGTGAACTTCACTACATGTTAAGTTACACTGAA
AGTTCATGTGCTTTTAATGTAGTCTAAAAGCCAAAGTATAGTGACTCAGAATCCTCAATCCACAAAACT
CAAGATTGGGAGCTCTTTGTGATCAAGCCAAAGAATTCTCATGTACTCTACCTTCAAGAAGCATTTCAA
GGCTAATACCTACTTGTACGTACATGTAAAACAAATCCCGCCGCAACTGTTTTCTGTTCTGTTGTTTGT
GGTTTTCTCATATGTATACTTGGTGGAATTGTAAGTGGATTTGCAGGCCAGGGAGAAAATGTCCAAGTA
ACAGGTGAAGTTTATTTGCCTGACGTTACTCCTTTCTAGATGAAAACCAAGCACAGATTTTAAAACTT
CTAAGATTATTCTCCTCTATCCACAGCATTCACNNNNNNNNNNNNNNNNNNNNNNNGTAGTGACAGCGAT
TTAGTGTTTTGTTTGATAAAGTATGCTTATTTCTGTGCCTACTGTATAATGGTTATCAAACAGTTGTCT
CAGGGGTACAAACTTTGAAAACAAGTGTGACACTGACCAGCCCAAATCATAATCATGTTTTCTTGCTGT
GATAGGTTTTGCTTGCCTTTTCATTATTTTTTAGCTTTTATGCTTGCTTCCATTATTTCAGTTGGTTGC
CCTAATATTTAAAATTTACACTTCTAAGACTAGAGACCCACATTTTTTAAAAATCATTTTATTTTGTGA
TACAGTGACAGTTTATATGAGCAAATTCAATATTATTCATAAGCATGTAATTCCAGTGACTTACTATG
TGAGATGACTACTAAGCAATATCTAGCAGCGTTAGTTCCATATAGTTCTGATTGGATTTCGTTCCTCCT
GAGGAGACCATGCCGTTGAGCTTGGCTACCCAGGCAGTGGTGATCTTTGACACCTTCTGGTGGATGTTC
CTCCCACTCATGAGTCTTTTCATCATGCCACATTATCTGATCCAGTCCTCACATTTTTAAATATAAAAC
TAAAGAGAGAATGCTTCTTACAGGAACAGTTACCCAAGGGCTGTTTCTTAGTAACTGTCATAAACTGAT
CTGGATCCATGGGCATACCTGTGTTCGAGGTGCAGCAATTGCTTGGTGAGCTGTGCAGAATTGATTGCC
TTCAGCACAGCATCCTCTGCCCACCCTTGTTTCTCATAAGCGATGTCTGGAGTGATTGTGGTTCTTGGA
AAAGCAGAAGGAAAAACTAAAAAGTGTATCTTGTATTTTCCCTGCCCTCAGGTTGCCTATGTATTTTAC
CTTTTCATATTTAAGGCAAAAGTACTTGAAAATTTTAAGTGTCCGAATAAGATATGTCTTTTTTGTTTG
```

TTTTTTTTGGTTGGTTGTTTGTTTTTTATCATCTGAGATTCTGTAATGTATTTGCAAATAATGGATCAA

TTAATTTTTTTTGAAGCTCATATTGTATCTTTTTAAAAACCATGTTGTGGAAAAAAGCCAGAGTGACAA

GTGACAAAATCTATTTAGGAACTCTGTGTATGAATCCTGATTTTAACTGCTAGGATTCAGCTAAATTTC

TGAGCTTTATGATCTGTGGAAATTTGGAATGAAATCGAATTCATTTTGTACATACATAGTATATTAAAA

CTATATAATGATTCAT<u>AGAAATGTTCAGTAATGAAAAAATATATCCAATCAGAGCCATCCCGAAAA</u>AAA

AAAAAAAA (SEQ ID NO: 3102).

The length of this sequence was determined using batch, automated computational methods and the sequence, as sense strand, its length, and the desired location of the probe sequence near the 3' end of the mRNA was submitted to Array Designer Ver 1.1 (Premier Biosoft International, Palo Alto, Calif.). Search quality was set at 100%, number of best probes set at 1, length range set at 50 base pairs, Target Tm set at 75 C. degrees plus or minus 5 degrees, Hairpin max deltaG at 6.0-kcal/mol., Self dimmer max deltaG at 6.0-kcal/mol, Run/repeat (dinucleotide) max length set at 5, and Probe site minimum overlap set at 1. When none of the 49 possible probes met the criteria, the probe site would be moved 50 base pairs closer to the 5' end of the sequence and resubmitted to Array Designer for analysis. When no possible probes met the criteria, the variation on melting temperature was raised to plus and minus 8 degrees and the number of identical base-pairs in a run increased to 6 so that a probe sequence was produced.

In the sequence above, using the criteria noted above, Array Designer Ver 1.1 designed a probe corresponding to oligo-nucleotide number 3037 and is indicated by underlining in the sequence above. It has a melting temperature of 68.4 degrees Celsius and a max run of 6 nucleotides and represents one of the cases where the criteria for probe design in Array Designer Ver 1.1 were relaxed in order to obtain an oligo-nucleotide near the 3' end of the mRNA (Low melting temperature was allowed).

Clone 463D12

Clone 463D12 was sequenced and compared to the nr, dbEST, and UniGene databases at NCBI using the BLAST search tool. The sequence matched accession number AI184553, an EST sequence with the definition line "qd60a05.x1 Soares_testis_NHT Homo sapiens cDNA clone IMAGE:1733840 3' similar to gb:M29550 PROTEIN PHOSPHATASE 2B CATALYTIC SUBUNIT 1 (HUMAN), mRNA sequence." The E value of the alignment was $1.00 \times 10^{-118}$. The GenBank sequence begins with a poly-T region, suggesting that it is the antisense strand, read 5' to 3'. The beginning of this sequence is complementary to the 3' end of the mRNA sense strand. The accession number for this sequence was included in a text file of accession numbers representing antisense sequences. Sequences for antisense strand mRNAs were obtained by uploading a text file containing desired accession numbers as an Entrez search query using the Batch Entrez web interface and saving the results locally as a FASTA file. The following sequence was obtained, and the region of alignment of clone 463D12 is outlined:

TTTTTTTTTTTTTTCTTAAATAGCATTTATTTTCTCTCAAAAAGCCTATTATGTACTAACAAGTGTTCC

TCTAAATTAGAAAGGCATCACTACTAAAATTTTATACATATTTTTTATATAAGAGAAGGAATATTGGGT

TACAATCTGAATTTCTCTTTATGATTTCTCTTAAAGTATAGAACAGCTATTAAAATGACTAATATTGCT

AAAATGAAGGCTACTAAATTTCCCCAAGAATTTCGGTGGAATGCCCAAAAATGGTGTTAAGATATGCAG

AAGGGCCCATTTCAAGCAAAGCAATCTCTCCACCCCTTCATAAAAGATTTAAGCTAAAAAAAAAAAAAA

AAGAA<u>GAAAATCCAACAGCTGAAGACATTGGGCTATTTATAAATCTTCTCCCAGTCCCCCAGACAGCCT</u>

<u>CACATGGGGCTGTAAACAGCTAACTAAAATATCTTTGAGACTCTTATGTCCACACCCACTGACACAAG</u>

<u>GAGAGCTGTAACCACAGTGAAACTAGACTTTGCTTTCCTTTAGCAAGTATGTGCCTATGATAGTAAACT</u>

<u>GGAGTAAATGTAACA</u>GTAATAAAACAAATTTTTTTAAAAATAAAAATTATACCTTTTCTCCAACAAA

CGGTAAAGACCACGTGAAGACATCCATAAAATTAGGCAACCAGTAAAGATGTGGAGAACCAGTAAACTG

TCGAAATTCATCACATTATTTTCATACTTTAATACAGCAGCTTTAATTATTGGAGAACATCAAAGTAAT

TAGGTGCCGAAAAACATTGTTATTAATGAAGGGAACCCCTGACGTTTGACCTTTTCTGTACCATCTATA

GCCCTGGACTTGA (SEQ ID NO: 3103)

The FASTA file, including the sequence of AA184553, was then masked using the RepeatMasker web interface, as shown below. The region of alignment of clone 463D12 is outlined.

of the reference sequence NT_008060, as depicted below, suggesting that the insert contains three spliced exons of an unidentified gene.

---

TTTTTTTTTTTTTCTTAAATAGCATTTATTTTCTCTCAAAAAGCCTATTATGTACTAACAAGTGTTCC

TCTAAATTAGAAAGGCATCACTACNNNNNNNNNNNNNNNNNNNNNNNNNNNNGAGAAGGAATATTGGGT

TACAATCTGAATTTCTCTTTATGATTTCTCTTAAAGTATAGAACAGCTATTAAAATGACTAATATTCCT

AAAATGAAGGCTACTAAATTCCCCAGAATTCGGTGGAATGCCCAAAAATGGTGTTAAGATATGCAG

AAGGGCCCATTTCAAGCAAAGCAATCTCTCCACCCCTTCATAAAAGATTTAAGCTAAAAAAAAAAAAAA

AAGAAGAAAATCCAACAGCTGAAGACATTGGGCTATTTATAAATCTTCTCCCAGTCCCCCAGACAGCCT

CACATGGGGGCTGTAAACAGCTAACTAAAATATCTTTGAGACTCTTATGTCCACACCCACTGACACAAG

GAGAGCTGTAACCACAGTGAAACTAGACTTTGCTTTCCTTTAGCAAGTATGTGCCTATGATAGTAAACT

GGAGTAAATGTAACAGNNNNNNNNNNNNNNNNNNNNNNNNNNNNNNNNNNNNNCCTTTTTCTCCAACAAA

CGGTAAAGACCACGTGAAGACATCCATAAAATTAGGCAACCAGTAAAGATGTGGAGAACCAGTAAACTG

TCGAAATTCATCACATTATTTTCATACTTTAATACAGCAGCTTTAATTATTGGAGAACATCAAAGTAAT

TAGGTGCCGAAAAACATTGTTATTAATGAAGGGAACCCCTGACGTTTGACCTTTTCTGTACCATCTATA

GCCCTGGACTTGA Masked version of 463D12 sequence. (SEQ ID NO: 3104)

---

The sequence was submitted to Array Designer as described above, however, the desired location of the probe was indicated at base pair 50 and if no probe met the criteria, moved in the 3' direction. The complementary sequence from Array Designer was used, because the original sequence was antisense. The oligonucleotide designed by Array Designer corresponds to oligonucleotide number 3054 and is complementary to the underlined sequence above. The probe has a melting temperature of 72.7 degrees centigrade and a max run of 4 nucleotides.

Clone 72D4

Clone 72D4 was sequenced and compared to the nr, dbEST, and UniGene databases at NCBI using the BLAST search tool. No significant matches were found in any of these databases. When compared to the human genome draft, significant alignments were found to three consecutive regions of the reference sequence NT_008060, as depicted below, suggesting that the insert contains three spliced exons of an unidentified gene.

| Residue numbers on clone 72D4 sequence | Matching residue numbers on NT_008060 |
|---|---|
| 1-198 | 478646-478843 |
| 197-489 | 479876-480168 |
| 491-585 | 489271-489365 |

Because the reference sequence contains introns and may represent either the coding or noncoding strand for this gene, BioCardia's own sequence file was used to design the oligonucleotide. Two complementary probes were designed to ensure that the sense strand was represented. The sequence of the insert in clone 72D4 is shown below, with the three putative exons outlined.

CAGGTCACACAGCACATCAGTGGCTACATGTGAGCTCAGACCTGGGTCTGCTGCTGTCTGT
CTTCCCAATATCCATGACCTTGACTGATGCAGGTGTCTAGGGATACGTCCATCCCCGTTCCT
GCTGGAGCCCAGAGCACGGAAGCCTGGCCCTCCGAGGAGACAGAAGGGAGTGTCGGACA
CCATGACGAGAGCTTGGCAGAATAAATAACTTCTTTAAACAATTTTACGGCATGAAGAAA
TCTGGACCAGTTTATTAAATGGGATTTCTGCCACAAACCTTGGAAGAATCACATCATCTTA
NNCCCAAGTGAAAACTGTGTTGCGTAACAAAGAACATGACTGCGCTCCACACATACATCA
TTGCCCGGCGAGGCGGGACACAAGTCAACGACGGAACACTTGAGACAGGCCTACAACTG
TGCACGGGTCAGAAGCAAGTTTAAGCCATACTTGCTGCAGTGAGACTACATTTCTGTCTAT
AGAAGATACCTGACTTGATCTGTTTTTCAGCTCCAGTTCCCAGATGTGCGTGTTGTGGTCC
CCAAGTATCACCTTCCAATTTCTGGGAGCAGTGCTCTGGCCGGATCCTTGCCGCGCGGAT
AAAAAC (SEQ ID NO: 3106)

The sequence was submitted to RepeatMasker, but no repetitive sequences were found. The sequence shown above was used to design the two 50-mer probes using Array Designer as described above. The probes are shown in bold typeface in the sequence depicted below. The probe in the sequence is oligonucleotide number 3020 (SEQ ID NO: 3020) and the complementary probe is oligonucleotide number 318 (SEQ ID NO:318). A portion of the target sequence is listed below (SEQ ID: 3106).

```
CAGGTCACACAGCACATCAGTGGCTACATGTGAGCTCAGACCTGGGTCTGCTGCTGTCTGTCTTCCCAA

TATCCATGACCTTGACTGATGCAGGTGTCTAGGGATACGTCCATCCCCGTCCTGCTGGAGCCCAGAGCA

CGGAAGCCTGGCCCTCCGAGGAGACAGAAGGGAGTGTCGGACACCATGACGAGAGCTTGGCAGAATAAA

TAACTTCTTTAAACAATTTTACGGCATGAAGAAATCTGGACCAGTTTATTAAATGGGATTTCTGCCACA

AACCTTGGAAGAATCACATCATCTTANNCCCAAGTGAAAACTGTGTTGCGTAACAAAGAACATGACTGC

GCTCCACACATACATCATTGCCCGGCGAGGCGGGACACAAGTCAACGACGGAACACTTGAGACAGGCCT

ACAACTGTGCACGGGTCAGAAGCAAGTTTAAGCCATACTTGCTGCAGTGAGACTACATTTCTGTCTATA

GAAGATACCTGACTTGATCTGTTTTTCAGCTCCAGTTCCCAGATGTGC

←----GTCAAGGGTCTACACG

GTGTTGTGGTCCCCAAGTATCACCTTCCAATTTCTGGGAG--→

CACAACACCAGGGGTTCATAGTGGAAGGTTAAAG-5'

CAGTGCTCTGGCCGGATCCTTGCCGCGCGGATAAAAACT---→
```

Confirmation of Probe Sequence

Following probe design, each probe sequence was confirmed by comparing the sequence against dbEST, the UniGene cluster set, and the assembled human genome using BLASTn at NCBI. Alignments, accession numbers, gi numbers, UniGene cluster numbers and names were examined and the most common sequence used for the probe.

Example 9

Production of an Array of 8000 Spotted 50mer Oligonucleotides

We produced an array of 8000 spotted initial candidate 50mer oligonucleotides. Example 8 exemplifies the design and selection of probes for this array.

Sigma-Genosys (The Woodlands, Tex.) synthesized unmodified 50-mer oligonucleotides using standard phosphoramidite chemistry, with a starting scale of synthesis of 0.05 µmole (see, e.g., R. Meyers, ed. (1995) *Molecular Biology and Biotechnology: A Comprehensive Desk Reference*). Briefly, to begin synthesis, a 3' hydroxyl nucleoside with a dimethoxytrityl (DMT) group at the 5' end was attached to a solid support. The DMT group was removed with trichloroacetic acid (TCA) in order to free the 5'-hydroxyl for the coupling reaction. Next, tetrazole and a phosphoramidite derivative of the next nucleotide were added. The tetrazole protonates the nitrogen of the phosphoramidite, making it susceptible to nucleophilic attack. The DMT group at the 5'-end of the hydroxyl group blocks further addition of nucleotides in excess. Next, the inter-nucleotide linkage was converted to a phosphotriester bond in an oxidation step using an oxidizing agent and water as the oxygen donor. Excess nucleotides were filtered out and the cycle for the next nucleotide was started by the removal of the DMT protecting group. Following the synthesis, the oligo was cleaved from the solid support. The oligonucleotides were desalted, resuspended in water at a concentration of 100 or 200 µM, and placed in 96-deep well format. The oligonucleotides were re-arrayed into Whatman Uniplate 384-well polyproylene V bottom plates. The oligonucleotides were diluted to a final concentration 30 µM in 1× Micro Spotting Solution Plus (Telechem/arrayit.com, Sunnyvale, Calif.) in a total volume of 15 µl. In total, 8,031 oligonucleotides were arrayed into twenty-one 384-well plates.

Arrays were produced on Telechem/arrayit.com Super amine glass substrates (Telechem/arrayit.com), which were manufactured in 0.1 mm filtered clean room with exact dimensions of 25×76×0.96 mm. The arrays were printed using the Virtek Chipwriter with a Telechem 48 pin Micro Spotting Printhead. The Printhead was loaded with 48 Stealth SMP3B TeleChem Micro Spotting Pins, which were used to print oligonucleotides onto the slide with the spot size being 110-115 microns in diameter.

Example 10

Identification of Diagnostic Nucleotide Sets for Diagnosis of Cardiac Allograft Rejection Genes were identified which have expression patterns useful for the diagnosis and monitoring of cardiac allograft rejection. Further, sets of genes that work together in a diagnostic algorithm for allograft rejection were identified. Patients, patient clinical data and patient samples used in the discovery of markers below were derived from a clinical study described in example 5.

The collected clinical data is used to define patient or sample groups for correlation of expression data. Patient groups are identified for comparison, for example, a patient group that possesses a useful or interesting clinical distinction, verses a patient group that does not possess the distinction. Measures of cardiac allograft rejection are derived from the clinical data described above to divide patients (and patient samples) into groups with higher and lower rejection activity over some period of time or at any one point in time. Such data are rejection grade as determined from pathologist reading of the cardiac biopsies and data measuring progression of end-organ damage, including depressed left ventricular dysfunction (decreased cardiac output, decreased ejection fraction, clinical signs of low cardiac output) and usage of inotropic agents (Kobashigawa 1998).

Expression profiles correlating with occurrence of allograft rejection are identified, including expression profiles corresponding to end-organ damage and progression of end-organ damage.

Expression profiles are identified predicting allograft rejection, and response to treatment or likelihood of response to treatment. Subsets of the candidate library (or a previously identified diagnostic nucleotide set) are identified, that have predictive value for the presence of allograft rejection or prediction of allograft rejection or end organ damage.

Mononuclear RNA samples were collected from patients who had recently undergone a cardiac allograft transplantation using the protocol described in example 2. The allograft rejection status at the time of sample collection was determined by examination of cardiac biopsies as described in example 5.

180 samples were included in the analysis. Each patient sample was associated with a biopsy and clinical data collected at the time of the sample. The cardiac biopsies were graded by a pathologist at the local center and by a centralized pathologist who read the biopsy slides from all four local centers in a blinded manner. Biopsy grades included 0, 1A, 1B, 2, 3A, and 3B. No grade 4 rejection was identified. Dependent variables were developed based on these grades using either the local center pathology reading or the higher of the two readings, local or centralized. The dependent variables used for correlation of gene expression profiles with cardiac allograft rejection are shown in Table 4. Dependent variables are used to create classes of samples corresponding to the presence or absence of rejection.

Clinical data were also used to determine criteria for including samples in the analysis. The strictest inclusion criteria required that samples be from patients who did not have a bacterial or viral infection, were at least two weeks post cardiac transplant and were not currently admitted to the hospital. A second inclusion criteria (inclusion 2) reduced the post-transplant criteria to 1 week and eliminated the hospital admission criteria.

After preparation of RNA (example 2), amplification, labeling, hybridization, scanning, feature extraction and data processing were done as described in Example 11, using the oligonucleotide microarrays described in Example 9. The resulting log ratio of expression of Cy3 (patient sample)/Cy5 (R50 reference RNA) was used for analysis. This dataset is called the "static" data. A second type of dataset, referenced, was derived from the first. These datasets compared the gene expression log ratio in each sample to a baseline sample from the same patient using the formula:

$$ref \text{ log ratio} = (\log \text{ratio}_{sample}) - (\log \text{ratio}_{baseline})$$

Two referenced datasets were used, named "0 HG" and "Best 0". The baseline for 0 HG was a Grade 0 sample from the same patient as the sample, using the highest grade between the centralized and local pathologists. The baseline for Best 0 was a Grade 0 sample from the same patient as the sample, using both the local and centralized reader biopsy grade data. When possible a Grade 0 prior to the sample was used as the baseline in both referenced datasets.

The datasets were also divided into subsets to compare analysis between two subsets of roughly half of the data. The types of subsets constructed were as follows. First half/second half subsets were the first half of the samples and the second half of the samples from a dataset ordered by sample number. Odd/even subsets used the same source, a dataset ordered by sample number, but the odd subset consisted of every $2^{nd}$ sample starting with the first and the even subset consisted of every $2^{nd}$ sample starting with the second sample, Center 14/other subsets were the same datasets, divided by transplant hospital. The center 14 subset consisted of all samples from patients at center 14, while the other subset consisted of all samples from the other three centers (12,13, and 15).

Initially, significance analysis for microarrays (SAM, Tusher 2001, Example 15) was used to discover genes that were differentially expressed between the rejection and no-rejection groups. Ninety-six different combinations of dependent variables, inclusion criteria, static/referenced, and data subsets were used in SAM analysis to develop the primary lists of genes significantly differentially expressed between rejection and no-rejection. The most significant of these genes were chosen based on the following criteria. Tier 1 genes were those which appeared with an FDR of less than 20% in identical analyses in two independent subsets. Tier 2 genes were those which appeared in the top 20 genes on the list with an FDR less than 20% more than 50% of the time over all dependent variables with the inclusion criteria, and static/referenced constant. Tier 3 genes were those that appeared more than 50% of the time with an FDR less than 20% more than 50% of the time over all dependent variables with the inclusion criteria, and static/referenced constant. The genes that were identified by the analysis as statistically differentially expressed between rejection and no rejection are shown in Table 2.

SAM chooses genes as significantly different based on the magnitude of the difference between the groups and the variation among the samples within each group. An example of the difference between some Grade 0 and some Grade 3A samples for 9 genes is shown in FIG. 7A.

Additionally, many of these same combinations were used in the Supervised Harvesting of Expression Trees (SHET, Hastie et al. 2001) algorithm (see example 15) to identify markers that the algorithm chose as the best to distinguish between the rejection and no rejection classes using a bias factor of 0.01. The top 20 or 30 terms were taken from the SHET output and among all comparisons in either the static or referenced data the results were grouped. Any gene found in the top 5 terms in more than 50% of the analyses was selected to be in group B1 (Table 2). The occurrences of each gene were tabulated over all SHET analysis (for either static or referenced data) and the 10 genes that occurred the most were selected to be in group B2 (Table 2).

An additional classification method used was CART (Salford Systems, San Diego, example 15). Either the static or referenced dataset was reduced to only the genes for which expression values (log ratios) were present in at least 80% of the samples. These data were used in CART with the default settings, using the Symmetric Gini algorithm. Each of the dependent variables was used with both the full sample set and the strict inclusion criteria. Two groups of genes were identified. Group C1 were those genes that were a primary splitter ($1^{st}$ decision node). Group C2 genes were the 10 genes that occurred as splitters the most often over all these analyses.

Two other classification models were developed and their best genes identified as markers of cardiac allograft rejection. Group D genes were identified from a set of 59 samples, referenced data, local biopsy reading grade, using logistic regression. Group E genes were identified from the primary static dataset using a K-nearest neighbor classification algorithm.

Both hierarchical clustering (Eisen et al. 1998) and CART were used to identify surrogates for each identified marker. Hierarchical clustering surrogates are genes co-expressed in these and were chosen from the nearest branches of the dendrogram. CART surrogates were identified by CART as the surrogates for those genes chosen as primary splitters at decision nodes.

Primers for real-time PCR validation were designed for each of the marker genes as described in Example 13.

CART was used to build a decision tree for classification of samples as rejection or no-rejection using the gene expression data from the arrays. The analysis identified sets of genes that can be used together to accurately identify samples derived from cardiac allograft transplant patients. The set of genes and the identified threshold expression levels for the decision tree are referred to as a "models". This model can be used to predict the rejection state of an unknown sample. The input data were the static expression data (log ratio) and the referenced expression data (log ratio referenced to the best available grade 0 from either the centralized reader or the local reader) for 139 of our top marker genes. These two types of expression data were entered into the CART software as independent variables. The dependent variable was rejection state, defined for this model as no rejection=grade 0 and rejection=grade 3A. Samples were eliminated from consideration in the training set if they were from patients with either bacterial or viral infection or were from patients who were less than two weeks post-transplant. The method used was Symmetric Gini, allowing linear combinations of independent variables. The costs were set to 1 for both false negatives and false positives and the priors were set equal for the two states. No penalties were assessed for missing data, however the marker genes selected have strong representation across the dataset. 10-fold cross validation was used to test the model. Settings not specified remained at the default values.

The model shown in FIG. 7B is based on decisions about expression values at three nodes, each a different marker gene. The cost assigned to this model is 0.292, based on the priors being equal, the costs set to 1 for each type of error, and the results from the 10-fold cross validation.

In the training set, no rejection samples were misclassified (sensitivity=100%) and only 1 no-rejection sample was misclassified (specificity=94.4%). Following 10-fold cross validation, 2 rejection samples were misclassified (sensitivity=87.5%) and 3 no-rejection samples were misclassified (specificity=83.3%). The CART software assigns surrogate markers for each decision node.

These genes can be used alone or in association with other genes or variables to build a diagnostic gene set or a classification algorithm. These genes can be used in association with known gene markers for rejection (such as those identified in the prior art) to provide a diagnostic algorithm.

Example 11

Amplification, Labeling and Hybridization of Total RNA to an Oligonucleotide Microarray Amplification, Labeling, Hybridization and Scanning Samples consisting of at least 0.5 to 2 µg of intact total RNA were further processed for array hybridization. When available, 2 µg of intact total RNA is used for amplification. Amplification and labeling of total RNA samples was performed in three successive enzymatic reactions. First, a single-stranded DNA copy of the RNA was made (hereinafter, "ss-cDNA"). Second, the ss-cDNA was used as a template for the complementary DNA strand, producing double-stranded cDNA (hereinafter, "ds-cDNA, or cDNA"). Third, linear amplification was performed by in vitro transcription from a bacterial $T_7$ promoter. During this step, fluorescent-conjugated nucleotides were incorporated into the amplified RNA (hereinafter, "aRNA").

The first strand cDNA was produced using the Invitrogen kit (Superscript II). The first strand cDNA was produced in a reaction composed of 50 mM Tris-HCl (pH 8.3), 75 mM KCl, and 3 mM $MgCl_2$ (1× First Strand Buffer, Invitrogen), 0.5 mM dGTP, 0.5 mM dATP, 0.5 mM dTTP, 0.5 mM dCTP, 10 mM DTT, 200 U reverse transcriptase (Superscript II, Invitrogen, #18064014), 15 U RNase inhibitor (RNAGuard, Amersham Pharmacia, #27-0815-01), 5 µM T7T24 primer (5'-GGCCAGTGAATTGTAATACGACTCAC-TATAGGGAGGCGGTTTTTTTTTTTTTTTTTTTTTTTT-3'), (SEQ ID NO:3105) and 0.5 to 2 µg of selected sample total RNA. Several purified, recombinant control mRNAs from the plant *Arabidopsis thaliana* were added to the reaction mixture: 2-20 pg of the following genes CAB, RCA, LTP4, NAC1, RCP1, XCP2, RBCL, LTP6, TIM, and PRKase (Stratagene, #252201, #252202, #252204, #252208, #252207, #252206, #252203, #252210 respectively). The control RNAs allow the estimate of copy numbers for individual mRNAs in the clinical sample because corresponding sense oligonucleotide probes for each of these plant genes are present on the microarray. The final reaction volume of 20 µl was incubated at 42° C. for 90 min. For synthesis of the second cDNA strand, DNA polymerase and RNase were added to the previous reaction, bringing the final volume to 150 µl. The previous contents were diluted and new substrates were added to a final concentration of 20 mM Tris-HCl (pH 7.0) (Fisher Scientific, Pittsburgh, Pa. #BP1756-100), 90 mMKCl (Teknova, Half Moon Bay, Calif., #0313-500), 4.6 mM $MgCl_2$ (Teknova, Half Moon Bay, Calif., #0304-500), 10 mM $(NH_4)_2SO_4$ (Fisher Scientific #A702-500)(1× Second Strand buffer, Invitrogen), 0.266 mM dGTP, 0.266 mM daTP, 0.266 mM dTTP, 0.266 mM dCTP, 40 U *E. coli* DNA polymerase (Invitrogen, #18010-025), and 2 U RNaseH (Invitrogen, #18021-014). The second strand synthesis took place at 16° C. for 150 minutes.

Following second-strand synthesis, the ds-cDNA was purified from the enzymes, dNTPs, and buffers before proceeding to amplification, using phenol-chloroform extraction followed by ethanol precipitation of the cDNA in the presence of glycogen.

Alternatively, a silica-gel column is used to purify the cDNA (e.g. Qiaquick PCR cleanup from Qiagen, #28104). The volume of the column purified cDNA was reduced by ethanol precipitation in the presence of glycogen in which the cDNA was collected by centrifugation at >10,000×g for 30 minutes, the supernatant is aspirated, and 150 µl of 70% ethanol, 30% water was added to wash the DNA pellet. Following centrifugation, the supernatant was removed, and residual ethanol was evaporated at room temperature. Alternatively, the volume of the column purified cDNA is reduce in a vacuum evaporator where the supernatant is reduce to a final volume of 7.4 µl.

Linear amplification of the cDNA was performed by in vitro transcription of the cDNA. The cDNA pellet from the step described above was resuspended in 7.4 µl of water, and in vitro transcription reaction buffer was added to a final volume of 20 µl containing 7.5 mM GTP, 7.5 mM ATP, 7.5 mM TTP, 2.25 mM CTP, 1.025 mM Cy3-conjugated CTP (Perkin Elmer; Boston, Mass., #NEL-580), 1× reaction buffer (Ambion, Megascript Kit, Austin, Tex. and #1334) and 1% $T_7$ polymerase enzyme mix (Ambion, Megascript Kit, Austin, Tex. and #1334). This reaction was incubated at 37° C. overnight. Following in vitro transcription, the RNA was purified from the enzyme, buffers, and excess NTPs using the RNeasy kit from Qiagen (Valencia, Calif.; #74106) as described in the vendor's protocol. A second elution step was performed and the two eluates were combined for a final volume of 60 µl. RNA is quantified using an Agilent 2100 bioanalyzer with the RNA 6000 nano LabChip. Reference RNA was prepared as described above, except Cy5-CTP was incorporated instead of Cy3CTP. Reference RNA from five reactions, each reaction started with 2 ug total RNA, was pooled together and quantitated as described above.

Hybridization to an Array

RNA was prepared for hybridization as follows: for an 18 mm×55 mm array, 20 µg of amplified RNA (aRNA) was combined with 20 µg of reference aRNA. The combined sample and reference aRNA was concentrated by evaporating the water to 10 µl in a vacuum evaporator. The sample was fragmented by heating the sample at 95° C. for 30 minutes to fragment the RNA into 50-200 bp pieces. Alternatively, the combined sample and reference aRNA was concentrated by evaporating the water to 5 µl in a vacuum evaporator. Five µl of 20 mM zinc acetate was added to the aRNA and the mix incubated at 60° C. for 10 minutes. Following fragmentation, 40 µl of hybridization buffer was added to achieve final concentrations of 5×SSC and 0.20% SDS with 0.1 µg/ul of Cot-1 DNA (Invitrogen) as a competitor DNA. The final hybridization mix was heated to 98° C., and then reduced to 50° C. at 0.1° C. per second.

Alternatively, formamide is included in the hybridization mixture to lower the hybridization temperature.

The hybridization mixture was applied to a pre-heated 65° C. microarray, surface, covered with a glass coverslip (Corning, #2935-246), and placed on a pre-heated 65° C. hybridization chamber (Telechem, AHC-10). 15 ul of 5×SSC was placed in each of the reservoir in the hybridization chamber and the chamber was sealed and placed in a water bath at 62° C. for overnight (16-20 hrs). Following incubation, the slides were washed in 2×SSC, 0.1% SDS for five minutes at 30° C., then in 2×SSC for five minutes at 30° C., then in 2×SSC for another five minutes at 30° C., then in 0.2×SSC for two minutes at room temperature. The arrays were spun at 1000×g for 2 minutes to dry them. The dry microarrays are then scanned by methods described above.

The microarrays were imaged on the Agilent (Palo Alto, Calif.) scanner G2565AA. The scan settings using the Agilent software were as follows: for the PMT Sensitivity (100% Red and 100% Green); Scan Resolution (10 microns); red and green dye channels; used the default scan region for all slides in the carousel; using the largest scan region; scan date for Instrument ID; and barcode for Slide ID. The full image produced by the Agilent scanner was flipped, rotated, and split into two images (one for each signal channel) using TIFFSplitter (Agilent, Palo Alto, Calif.). The two channels are the output at 532 nm (Cy3-labeled sample) and 633 nm (Cy5-labeled R50). The individual images were loaded into GenePix 3.0 (Axon Instruments, Union City, Calif.) for feature extraction, each image was assigned an excitation wavelength corresponding the file opened; Red equals 633 nm and Green equals 532 nm The setting file (gal) was opened and the grid was laid onto the image so that each spot in the grid overlapped with >50% of the feature. Then the GenePix software was used to find the features without setting minimum threshold value for a feature. For features with low signal intensity, GenePix reports "not found". For all features, the diameter setting was adjusted to include only the feature if necessary.

The GenePix software determined the median pixel intensity for each feature ($F_i$) and the median pixel intensity of the local background for each feature ($B_i$) in both channels. The standard deviation ($SDF_i$ and $SDB_i$) for each is also determined. Features for which GenePix could not discriminate the feature from the background were "flagged" as described below.

Following feature extraction into a ".gpr" file, the header information of the .gpr file was changed to carry accurate information into the database. An Excel macro was written to include the following information: Name of the original .tif image file, SlideID, Version of the feature extraction software, GenePix Array List file, GenePix Settings file, ScanID, Name of person who scanned the slide, Green PMT setting, Red PMT setting, ExtractID (date .gpr file was created, formatted as yyyy.mm.dd-hh.mm.ss), Results file name (same as the .gpr file name), StorageCD, and Extraction comments.

Pre-Processing with Excel Templates

Following analysis of the image and extraction of the data, the data from each hybridization was pre-processed to extract data that was entered into the database and subsequently used for analysis. The complete GPR file produced by the feature extraction in GenePix was imported into an excel file pre-processing template or processed using a AWK script. Both programs used the same processing logic and produce identical results. The same excel template or AWK script was used to process each GPR file. The template performs a series of calculations on the data to differentiate poor features from others and to combine duplicate or triplicate feature data into a single data point for each probe.

The data columns used in the pre-processing were: Oligo ID, F633 Median (median value from all the pixels in the feature for the Cy5 dye), B633 Median (the median value of all the pixels in the local background of the selected feature for Cy5), B633 SD (the standard deviation of the values for the pixels in the local background of the selected feature for Cy5), F532 Median (median value from all the pixels in the feature for the Cy3 dye), B532 Median (the median value of all the pixels in the local background of the selected feature for Cy3), B532 SD (the standard deviation of the values for the pixels in the local background of the selected feature for Cy3), and Flags. The GenePix Flags column contains the flags set during feature extraction. "−75" indicates there were no features printed on the array in that position, "−50" indicates that GenePix could not differentiate the feature signal from the local background, and "−100" indicates that the user marked the feature as bad.

Once imported, the data associated with features with −75 flags was not used. Then the median of B633 SD and B532 SD were calculated over all features with a flag value of "0". The minimum values of B633 Median and B532 Median were identified, considering only those values associated with a flag value of "0". For each feature, the signal to noise ratio (S/N) was calculated for both dyes by taking the fluorescence signal minus the local background (BGSS) and dividing it by the standard deviation of the local background:

$$S/N = \frac{F_i - B_i}{SDB_i}$$

If the S/N was less than 3, then an adjusted background-subtracted signal was calculated as the fluorescence minus the minimum local background on the slide. An adjusted S/N was then calculated as the adjusted background subtracted signal divided by the median noise over all features for that channel. If the adjusted S/N was greater than three and the original S/N were less than three, a flag of 25 was set for the Cy5 channel, a flag of 23 was set for the Cy3 channel, and if both met these criteria, then a flag of 28 was set. If both the adjusted S/N and the original S/N were less than three, then a flag of 65 was set for Cy5, 63 set for Cy3, and 68 set if both dye channels had an adjusted S/N less than three. All signal to noise calculations, adjusted background-subtracted signal, and adjusted S/N were calculated for each dye channel. If the BGSS value was greater than or equal to 64000, a flag was set to indicate saturation; 55 for Cy5, 53 for Cy3, 58 for both.

The BGSS used for further calculations was the original BGSS if the original S/N was greater than or equal to three. If the original S/N ratio was less than three and the adjusted S/N ratio was greater than or equal to three, then the adjusted BGSS was used. If the adjusted S/N ratio was less than three, then the adjusted BGSS was used, but with knowledge of the flag status.

To facilitate comparison among arrays, the Cy3 and Cy5 data were scaled. The log of the ratio of Green/Red was determined for all features. The median log ratio value for good features (Flags 0, 23, 25, 28, 63) was determined. The feature values were scaled using the following formula:

Log_Scaled_Feature_Ratio=Log_Feature_Ratio−Median_Log_Ratio.

The flag setting for each feature was used to determine the expression ratio for each probe, a choice of one, two or three features. If all features had flag settings in the same category (categories=negatives, 0 to 28, 53-58, and 63-68), then the average of the three scaled, anti log feature ratios was calculated If the three features did not have flags in the same category, then the feature or features with the best quality flags were used (0>25>23>28>55>53>58>65>63>68). Features with negative flags were never used. When the best flags were two or three features in the same category, the anti log average was used. If a single feature had a better flag category than the other two then the anti log of that feature ratio was used.

Once the probe expression ratios were calculated from the one, two, or three features, the log of the scaled, averaged ratios was taken as described below and stored for use in analyzing the data. Whichever features were used to calculate the probe value, the flag from those features was carried forward and stored as the flag value for that probe. 2 different data sets can be used for analysis. Flagged data uses all values, including those with flags. Filtered data sets are created by removing flagged data from the set before analysis.

Example 12

Real-Time PCR Validation of Array Expression Results

Leukocyte microarray gene expression was used to discover expression markers and diagnostic gene sets for clinical outcomes. It is desirable to validate the gene expression results for each gene using a more sensitive and quantitative technology such as real-time PCR. Further, it is possible for the diagnostic nucleotide sets to be implemented as a diagnostic test as a real-time PCR panel. Alternatively, the quantitative information provided by real-time PCR validation can be used to design a diagnostic test using any alternative quantitative or semi-quantitative gene expression technology. To validate the results of the microarray experiments we used real-time, or kinetic, PCR. In this type of experiment the amplification product is measured during the PCR reaction. This enables the researcher to observe the amplification before any reagent becomes rate limiting for amplification. In kinetic PCR the measurement is of $C_T$ (threshold cycle) or $C_P$ (crossing point). This measurement ($C_T = C_P$) is the point at which an amplification curve crosses a threshold fluorescence value. The threshold is set to a point within the area where all of the reactions were in their linear phase of amplification. When measuring $C_T$, a lower $C_T$ value is indicative of a higher amount of starting material since an earlier cycle number means the threshold was crossed more quickly.

Several fluorescence methodologies are available to measure amplification product in real-time PCR. Taqman (Applied BioSystems, Foster City, Calif.) uses fluorescence resonance energy transfer (FRET) to inhibit signal from a probe until the probe is degraded by the sequence specific binding and Taq 3' exonuclease activity. Molecular Beacons (Stratagene, La Jolla, Calif.) also use FRET technology, whereby the fluorescence is measured when a hairpin structure is relaxed by the specific probe binding to the amplified DNA. The third commonly used chemistry is Sybr Green, a DNA-binding dye (Molecular Probes, Eugene, Oreg.). The more amplified product that is produced, the higher the signal. The Sybr Green method is sensitive to non-specific amplification products, increasing the importance of primer design and selection. Other detection chemistries can also been used, such as ethedium bromide or other DNA-binding dyes and many modifications of the fluorescent dye/quencher dye Taqman chemistry.

Sample Prep and cDNA Synthesis

The inputs for real time PCR reaction are gene-specific primers, cDNA from specific patient samples, and standard reagents. The cDNA was produced from mononuclear RNA (prepared as in example 2) or whole blood RNA by reverse transcription using Oligo dT primers (Invitrogen, 18418-012) and random hexamers (Invitrogen, 48190-011) at a final concentration of 0.5 ng/µl and 3 ng/µl respectively. For the first strand reaction mix, 0.5 µg of mononuclear total RNA or 2 µg of whole blood RNA and 1 µl of the Oligo dT/Random Hexamer Mix, were added to water to a final volume of 11.5 µl. The sample mix was then placed at 70° C. for 10 minutes. Following the 70° C. incubation, the samples were chilled on ice, spun down, and 88.5 µl of first strand buffer mix dispensed into the reaction tube. The final first strand buffer mix produced final concentrations of 1× first strand buffer (Invitrogen, Y00146, Carlsbad, Calif.), 10 mM DTT (Invitrogen, Y00147), 0.5 mM daTP (NEB, N0440S, Beverly, Mass.), 0.5 mM dGTP (NEB, N0442S), 0.5 mM dTTP (NEB, N0443S), 0.5 mM dCTP (NEB, N0441S), 200U of reverse transcriptase (Superscript II, Invitrogen, 18064-014), and 18U of RNase inhibitor (RNAGaurd Amersham Pharmacia, 27-0815-01, Piscataway, N.J.). The reaction was incubated at 42° C. for 90 minutes. After incubation the enzyme was heat inactivated at 70° C. for 15 minutes, 2 U of RNAse H added to the reaction tube, and incubated at 37° C. for 20 minutes.

Primer Design

Two methods were used to design primers. The first was to use the software, Primer Express™ and recommendations for primer design that are provided with the GeneAmp® 7700 Sequence Detection System supplied by Applied BioSystems (Foster City, Calif.). The second method used to design primers was the PRIMER3 ver 0.9 program that is available from the Whitehead Research Institute, Cambridge, Mass. at the Whitehead Research web site. The program can also be accessed on the World Wide Web at the web site at the Massachusetts Institute of Technology website. Primers and Taqman/hybridization probes were designed as described below using both programs. The Primer Express literature explains that primers should be designed with a melting temperature between 58 and 60 degrees C. while the Taqman probes should have a melting temperature of 68 to 70 under the salt conditions of the supplied reagents. The salt concentration is fixed in the software. Primers should be between 15 and 30 basepairs long. The primers should produce and amplicon in size between 50 and 150 base pairs, have a C-G content between 20% and 80%, have no more than 4 identical base pairs next to one another, and no more than 2 C's and G's in the last 5 bases of the 3' end. The probe cannot have a G on the 5' end and the strand with the fewest G's should be used for the probe.

Primer3 has a large number of parameters. The defaults were used for all except for melting temperature and the optimal size of the amplicon was set at 100 bases. One of the most critical is salt concentration as it affects the melting temperature of the probes and primers. In order to produce primers and probes with melting temperatures equivalent to Primer Express, a number of primers and probes designed by Primer Express were examined using PRIMER3. Using a salt concentration of 50 mM these primers had an average melting temperature of 3.7 degrees higher than predicted by Primer Express. In order to design primers and probes with equivalent melting temperatures as Primer Express using PRIMER3, a melting temperature of 62.7 plus/minus 1.0 degree was used in PRIMER3 for primers and 72.7 plus/minus 1.0 degrees for probes with a salt concentration of 50 mM.

The C source code for Primer3 was downloaded and complied on a Sun Enterprise 250 server using the GCC complier. The program was then used from the command line using a input file that contained the sequence for which we wanted to design primers and probes along with the input parameters as described by help files that accompany the software. Using scripting it was possible to input a number of sequences and automatically generate a number of possible probes and primers.

Primers for β-Actin (Beta Actin, Genbank Locus: NM_001101) and β-GUS: glucuronidase, beta, (GUSB, Genbank Locus: NM_000181), two reference genes, were designed using both methods and are shown here as examples:

The first step was to mask out repetitive sequences found in the mRNA sequences using RepeatMasker program that can be accessed at: the web site University of Washington Genome RepeatMasker website. (Smit, A. F. A. & Green, P.).

The last 500 basepairs on the last 3' end of masked sequence was then submitted to PRIMER3 using the following exemplary input sequences:

```
PRIMER_SEQUENCE_ID=>ACTB Beta Actin (SEQID 3083)
SEQUENCE = TTGGCTTGACTCAGGATTTAAAAACTGGAACGGTGAAGGTGACAGCAGTCGGTTGGACGA

GCATCCCCCAAAGTTCACAATGTGGCCGAGGACTTTGATTGCACATTGTTGTTTTTAATAGTCATTCC

AAATATGAGATGCATTGTTACAGGAAGTCCCTTGCCATCCTAAAAGCACCCCACTTCTCTCTAAGGAGA

ATGGCCCAGTCCTCTCCCAAGTCCACACAGGGGAGGGATAGCATTGCTTTCGTGTAAATTATGTAATGC

AAAATTTTTTAATCTTCGCCTTAATCTTTTTATTTTGTTTTATTTTGAATGATGAGCCTTCGTGCCC

CCCCTTCCCCCTTTTTTCCCCCAACTTGAGATGTATGAAGGCTTTTGGTCTCCCTGGGAGTGGGTGGAG

GCAGCCGGGCTTACCTGTACACTGACTTGAGACCAGTTGAATAAAAGTGCACACCTTA

PRIMER_SEQUENCE_ID=>GUSB (SEQID 3084)
SEQUENCE = GAAGAGTACCAGAAAAGTCTGCTAGAGCAGTACCATCTGGGTCTGGATCAAAAACGCAGA

AAATATGTGGTTGGAGAGCTCATTTGGAATTTTGCCGATTTCATGACTGAACAGTCACCGACGAGAGTG

CTGGGGAATAAAAAGGGGATCTTCACTCGGCAGAGACAACCAAAAAGTGCAGCGTTCCTTTTGCGAGAG

AGATACTGGAAGATTGCCAATGAAACCAGGTATCCCCACTCAGTAGCCAAGTCACAATGTTTGGAAAAC

AGCCCGTTTACTTGAGCAAGACTGATACCACCTGCGTGTCCCTTCCTCCCCGAGTCAGGGCGACTTCCA

CAGCAGCAGAACAAGTGCCTCCTGGACTGTTCACGGCAGACCAGAACGTTTCTGGCCTGGGTTTTGTGG

TCATCTATTCTAGCAGGGAACACTAAAGGTGGAAATAAAAGATTTTCTATTATGGAAATAAAGAGTTGG

CATGAAAGTCGCTACTG
```

After running PRIMER3, 100 sets of primers and probes were generated for ACTB and GUSB. From this set, nested primers were chosen based on whether both left primers could be paired with both right primers and a single Taqman probe could be used on an insert of the correct size. With more experience we have decided not use the mix and match approach to primer selection and just use several of the top pairs of predicted primers.

```
For ACTB this turned out to be:
Forward 75    CACAATGTGGCCGAGGACTT,    (SEQID 3085)

Forward 80    TGTGGCCGAGGACTTTGATT,    (SEQID 3086)

Reverse 178   TGGCTTTTAGGATGGCAAGG,    (SEQID 3087)
and

Reverse 168   GGGGGCTTAGTTTGCTTCCT.    (SEQID 3088)
```

Upon testing, the F75 and R178 pair worked best.

```
For GUSB the following primers were chosen:
Forward 59    AAGTGCAGCGTTCCTTTTGC,    (SEQID 3089)

Forward 65    AGCGTTCCTTTTGCGAGAGA,    (SEQID 3090)

Reverse 158   CGGGCTGTTTTCCAAACATT,    (SEQID 3091)
and

Reverse 197   GAAGGGACACGCAGGTGGTA.    (SEQID 3092)
```

No combination of these GUSB pairs worked well. No combination of these GUSB pairs worked well.

In addition to the primer pairs above, Primer Express predicted the following primers for GUSB: Forward 178 TAC CACCTGCGTGTCCCTTC (SEQID 3093) and Reverse 242 GAGGCACTTGTTCTGCTGCTG (SEQID 3094). This pair of primers worked to amplify the GUSB mRNA.

The parameters used to predict these primers in Primer Express were:

Primer Tm: min 58, Max=60, opt 59, max difference=2 degrees

Primer GC: min=20% Max=80% no 3' G/C clamp

Primer: Length: min=9 max=40 opt=20

Amplicon: min Tm=0 max Tm=85 min=50 bp max=150 bp

Probe: Tm 10 degrees>primers, do not begin with a G on 5' end

Other: max base pair repeat=3 max number of ambiguous residues=0 secondary structure: max consecutive bp=4, max total bp=8

Uniqueness: max consecutive match=9 max % match=75 max 3' consecutive match=7

Granzyme B is a marker of transplant rejection.

For Granzyme B the following sequence (NM_004131) (SEQID 3096) was used as input for Primer3:

```
GGGGACTCTGGAGGCCCTCTTGTGTGTAACAAGGTGGCCCAGGGCATTGT

CTCCTATGGACGAAACAATGGCATGCCTCCACGAGCCTGCACCAAAGTCT
```

-continued

CAAGCTTTGTACACTGGATAAAGAAAACCATGAAACGCTACTAACTACAG

GAAGCAAACTAAGCCCCCGCTGTAATGAAACACCTTCTCTGGAGCCAAGT

CCAGATTTACACTGGGAGAGGTGCCAGCAACTGAATAAATACCTCTCCCA

GTGTAAATCTGGAGCCAAGTCCAGATTTACACTGGGAGAGGTGCCAGCAA

CTGAATAAATACCTCTTAGCTGAGTGG

```
For Granzyme B the following primers were chosen
for testing:
Forward 81    ACGAGCCTGCACCAAAGTCT    (SEQID 3097)

Forward 63    AAACAATGGCATGCCTCCAC    (SEQID 3098)

Reverse 178   TCATTACAGCGGGGGCTTAG    (SEQID 3099)

Reverse 168   GGGGGCTTAGTTTGCTTCCT    (SEQID 3100)
```

Testing demonstrated that F81 and R178 worked well.

Using this approach, primers were designed for all the genes that were shown to have expression patterns that correlated with allograft rejection. These primer pairs are shown in Table 2, Table 8, and are added to the sequence listing. Primers can be designed from any region of a target gene using this approach.

Primer Endpoint Testing

Primers were first tested to examine whether they would produce the correct size product without non-specific amplification. The standard real-time PCR protocol was used without the Rox and Sybr green dyes. Each primer pair was tested on cDNA made from universal mononuclear leukocyte reference RNA that was produced from 50 individuals as described in Example 3 (R50).

The PCR reaction consisted of 1× RealTime PCR Buffer (Ambion, Austin, Tex.), 2 mM MgCl2 (Applied BioSystems, B02953), 0.2 mM dATP (NEB), 0.2 mM dTTP (NEB), 0.2 mM dCTP (NEB), 0.2 mM dGTP (NEB), 625U AmpliTaq Gold (Applied BioSystems, Foster City, Calif.), 0.3 µM of each primer to be used (Sigma Genosys, The Woodlands, Tex.), 5 µl of the R50 reverse-transcription reaction and water to a final volume of 19 µl.

Following 40 cycles of PCR, 10 microliters of each product was combined with Sybr green at a final dilution of 1:72,000. Melt curves for each PCR product were determined on an ABI 7900 (Applied BioSystems, Foster City, Calif.), and primer pairs yielding a product with one clean peak were chosen for further analysis. One microliter of the product from these primer pairs was examined by agarose gel electrophoresis on an Agilent Bioanalyzer, DNA 1000 chip (Palo Alto, Calif.). Results for 2 genes are shown in FIG. 9. From the primer design and the sequence of the target gene, one can calculate the expected size of the amplified DNA product. Only primer pairs with amplification of the desired product and minimal amplification of contaminants were used for real-time PCR. Primers that produced multiple products of different sizes are likely not specific for the gene of interest and may amplify multiple genes or chromosomal loci.

Primer Optimization/Efficiency

Once primers passed the end-point PCR, the primers were tested to determine the efficiency of the reaction in a real-time PCR reaction. cDNA was synthesized from starting total RNA as described above. A set of 5 serial dilutions of the R50 reverse-transcribed cDNA (as described above) were made in water: 1:10, 1:20, 1:40, 1:80, and 1:160.

The Sybr Green real-time PCR reaction was performed using the Taqman PCR Reagent kit (Applied BioSystems, Foster City, Calif., N808-0228). A master mix was made that consisted of all reagents except the primes and template. The final concentration of all ingredients in the reaction was 1× Taqman Buffer A (Applied BioSystems), 2 mM MgCl2 (Applied BioSystems), 200 µM dATP (Applied BioSystems), 200 µM dCTP (Applied BioSystems), 200 µM dGTP (Applied BioSystems), 400 µM dUTP (Applied BioSystems), 1:400,000 diluted Sybr Green dye (Molecular Probes), 1.25U AmpliTaq Gold (Applied BioSystems). The PCR master mix was dispensed into two, light-tight tubes. Each β-Actin primer F75 and R178 (Sigma-Genosys, The Woodlands, Tex.), was added to one tube of PCR master mix and Each β-GUS primer F178 and R242 (Sigma-Genosys), was added to the other tube of PCR master mix to a final primer concentration of 300 nM. 45 µl of the β-Actin or β-GUS master mix was dispensed into wells, in a 96-well plate (Applied BioSystems). 5 µl of the template dilution series was dispensed into triplicate wells for each primer. The reaction was run on an ABI 7900 Sequence Detection System (Applied BioSystems) with the following conditions: 10 min. at 95° C.; 40 cycles of 95° C. for 15 sec, 60° C. for 1 min; followed by a disassociation curve starting at 50° C. and ending at 95° C.

The Sequence Detection System v2.0 software was used to analyze the fluorescent signal from each well. The high end of the baseline was adjusted to between 8 and 20 cycles to reduce the impact on any data curves, yet be as high as possible to reduce baseline drift. A threshold value was selected that allowed the majority of the amplification curves to cross the threshold during the linear phase of amplification. The disassociation curve for each well was compared to other wells for that marker. This comparison allowed identification of "bad" wells, those that did not amplify, that amplified the wrong size product, or that amplified multiple products. The cycle number at which each amplification curve crossed the threshold ($C_T$) was recorded and the file transferred to MS Excel for further analysis. The $C_T$ values for triplicate wells were averaged. The data were plotted as a function of the $\log_{10}$ of the calculated starting concentration of RNA. The starting RNA concentration for each cDNA dilution was determined based on the original amount of RNA used in the RT reaction, the dilution of the RT reaction, and the amount used (5 µl) in the real-time PCR reaction. For each gene, a linear regression line was plotted through all of the dilutions series points. The slope of the line was used to calculate the efficiency of the reaction for each primer set using the equation:

$$E = 10^{(-1/scope)} - 1$$

Using this equation (Pfaffl 2001, Applied Biosystems User Bulletin #2), the efficiency for these β-actin primers is 1.28 and the efficiency for these β-GUS primers is 1.14 (FIG. 10). This efficiency was used when comparing the expression levels among multiple genes and multiple samples. This same method was used to calculate reaction efficiency for primer pairs for each gene studied. A primer pair was considered successful if the efficiency was reproducibly determined to be between 0.7 and 2.4.

SYBR-Green Assays

Once markers passed the Primer Efficiency QPCR (as stated above), they were used in real-time PCR assays. Patient RNA samples were reverse-transcribed to cDNA (as described above) and 1:10 dilutions made in water. In addition to the patient samples, a no template control (NTC) and a pooled reference RNA (see example 3) described in were included on every plate.

The Sybr Green real-time PCR reaction was performed using the Taqman Core PCR Reagent kit (Applied BioSystems, Foster City, Calif., N808-0228). A master mix was made that consisted of all reagents except the primers and template. The final concentration of all ingredients in the reaction was 1× Taqman Buffer A (Applied BioSystems), 2 mM MgCl2 (Applied BioSystems), 200 µM dATP (Applied BioSystems), 200 µM dCTP (Applied BioSystems), 200 µM dGTP (Applied BioSystems), 400 µM dUTP (Applied BioSystems), 1:400,000 diluted Sybr Green dye (Molecular Probes), 1.25U AmpliTaq Gold (Applied BioSystems). The PCR master mix was aliquoted into eight light-tight tubes, one for each marker to be examined across a set of samples. The optimized primer pair for each marker was then added to the PCR master mix to a final primer concentration of 300 nM. 18 µl of the each marker master mix was dispensed into wells in a 384 well plate (Applied BioSystems). 2 µl of the 1:10 diluted control or patient cDNA sample was dispensed into triplicate wells for each primer pair. The reaction was run on an ABI 7900 Sequence Detection System (Applied BioSystems) using the cycling conditions described above.

The Sequence Detection System v2.0 software (Applied BioSystems) was used to analyze the fluorescent signal from each well. The high end of the baseline was adjusted to between 8 and 20 cycles to reduce the impact on any data curves, yet be as high as possible to reduce baseline drift. A threshold value was selected that allowed the majority of the amplification curves to cross the threshold during the linear phase of amplification. The disassociation curve for each well was compared to other wells for that marker. This comparison allowed identification of "bad" wells, those that did not amplify, that amplified the wrong size product, or that amplified multiple products. The cycle number at which each amplification curve crossed the threshold ($C_T$) was recorded and the file transferred to MS Excel for further analysis. The $C_T$ value representing any well identified as bad by analysis of disassociation curves was deleted. The $C_T$ values for triplicate wells were averaged. A standard deviation (Stdev) and a coefficient of variation (CV) were calculated for the triplicate wells. If the CV was greater than 2, an outlier among the three wells was identified and deleted. Then the average was re-calculated. In each plate, $\Delta C_T$ was calculated for each marker-control combination by subtracting the average $C_T$ of the target marker from the average $C_T$ of the control (β-Actin or β-GUS). The expression relative to the control marker was calculated by taking two to the power of the $\Delta C_T$ of the target marker. For example, expression relative to β-Actin was calculated by the equation:

$$ErA = 2^{(C_{T,Actin} - C_{T,\arg et})}$$

All plates were run in duplicate and analyzed in the same manner. The percent variation was determined for each sample-marker combination (relative expression) by taking the absolute value of the value of the RE for the second plate from the RE for the first plate, and dividing that by the average. If more than 25% of the variation calculations on a plate are greater than 50%, then a third plate was run.

Taqman Protocol

Real-time PCR assays were also done using Taqman PCR chemistry.

The Taqman real-time PCR reaction was performed using the Taqman Universal PCR Master Mix (Applied BioSystems, Foster City, Calif., #4324018). The master mix was aliquoted into eight, light-tight tubes, one for each marker. The optimized primer pair for each marker was then added to the correctly labeled tube of PCR master mix. A FAM/TAMRA dual-labeled Taqman probe (Biosearch Technologies, Navoto, Calif., DLO-FT-2) was then added to the correctly labeled tube of PCR master mix. Alternatively, different combinations of fluorescent reporter dyes and quenchers can be used such that the absorption wavelength for the quencher matches the emission wavelength for the reporter, as shown in Table 5. 18 µl of the each marker master mix was dispensed into a 384 well plate (Applied BioSystems). 2 µl of the template sample was dispensed into triplicate wells for each primer pair. The final concentration of each reagent was: 1× TaqMan Universal PCR Master Mix, 300 nM each primer, 0.25 nM probe, 2 µl 1:10 diluted template. The reaction was run on an ABI 7900 Sequence Detection System (Applied Biosystems) using standard conditions (95° C. for 10 min., 40 cycles of 95° C. for 15 sec, 60° C. for 1 min.).

The Sequence Detector v2.0 software (Applied BioSystems) was used to analyze the fluorescent signal from each well. The high end of the baseline was adjusted to between 8 and 20 cycles to reduce the impact on any data curves, yet be as high as possible to reduce baseline drift. A threshold value was selected that allowed most of the amplification curves to cross the threshold during the linear phase of amplification. The cycle number at which each amplification curve crossed the threshold ($C_T$) was recorded and the file transferred to MS Excel for further analysis. The $C_T$ values for triplicate wells were averaged. The $C_T$ values for triplicate wells were averaged. A standard deviation (Stdev) and a coefficient of variation (CV) were calculated for the triplicate wells. If the CV was greater than 2, an outlier among the three wells was identified and deleted. Then the average was re-calculated. In each plate, $\Delta C_T$ was calculated for each marker-control combination by subtracting the average $C_T$ of the target marker from the average $C_T$ of the control (β-Actin or β-GUS). The expression relative to the control marker was calculated by taking two to the power of the $\Delta C_T$ of the target marker. All plates were run in duplicate and analyzed in the same manner. The percent variation was determined for each sample-marker combination (relative expression) by taking the absolute value of the value of the RE for the second plate from the RE for the first plate, and dividing that by the average. If more than 25% of the variation calculations on a plate are greater than 50%, then a third plate was run.

Bi-Plexing

Variation of real-time PCR assays can arise from unequal amounts of RNA starting material between reactions. In some assays, to reduce variation, the control gene amplification was included in the same reaction well as the target gene. To differentiate the signal from the two genes, different fluorescent dyes were used for the control gene. β-Actin was used as the control gene and the TaqMan probe used was labeled with the fluorescent dye VIC and the quencher TAMRA (Biosearch Technologies, Navoto, Calif., DLO-FT-2). Alternatively, other combinations of fluorescent reporter dyes and quenchers (Table 5) can be used as long as the emission wavelength of the reporter for the control gene is sufficiently different from the wavelength of the reporter dye used for the target. The control gene primers and probe were used at limiting concentrations in the reaction (150 nM primers and 0.125 nM probe) to ensure that there were enough reagents to amplify the target marker. The plates were run under the same protocol and the data are analyzed in the same way, but with a separate baseline and threshold for the VIC signal. Outliers were removed as above from both the FAM and VIC signal channels. The expression relative to control was calculated as above, using the VIC signal from the control gene.

Absolute Quantitation

Instead of calculating the expression relative to a reference marker, an absolute quantitation can be performed using real-time PCR. To determine the absolute quantity of each marker, a standard curve is constructed using serial dilutions from a known amount of template for each marker on the plate. The standard curve may be made using cloned genes purified from bacteria or using synthetic complimentary oligonucleotides. In either case, a dilution series that covers the expected range of expression is used as template in a series of wells in the plate. From the average $C_T$ values for these known amounts of template a standard curve can be plotted. From this curve the $C_T$ values for the unknowns are used to identify the starting concentration of cDNA. These absolute quantities can be compared between disease classes (i.e. rejection vs. no-rejection) or can be taken as expression relative to a control gene to correct for variation among samples in sample collection, RNA purification and quantification, cDNA synthesis, and the PCR amplification.

Cell Type Specific Expression

Some markers are expressed only in specific types of cells. These markers may be useful markers for differentiation of rejection samples from no-rejection samples or may be used to identify differential expression of other markers in a single cell type. A specific marker for cytotoxic T-lymphocytes (such as CD8) can be used to identify differences in cell proportions in the sample. Other markers that are known to be expressed in this cell type can be compared to the level of CD8 to indicate differential gene expression within CD8 T-cells.

Control Genes for PCR

As discussed above, PCR expression measurements can be made as either absolute quantification of gene expression using a standard curve or relative expression of a gene of interest compared to a control gene. In the latter case, the gene of interest and the control gene are measured in the same sample. This can be done in separate reactions or in the same reaction (biplex format, see above). In either case, the final measurement for expression of a gene is expressed as a ratio of gene expression to control gene expression. It is important for a control gene to be constitutively expressed in the target tissue of interest and have minimal variation in expression on a per cell basis between individuals or between samples derived from an individual. If the gene has this type of expression behavior, the relative expression ratio will help correct for variability in the amount of sample RNA used in an assay. In addition, an ideal control gene has a high level of expression in the sample of interest compared to the genes being assayed. This is important if the gene of interest and control gene are used in a biplex format. The assay is set up so that the control gene reaches its threshold Ct value early and its amplification is limited by primers so that it does not compete for limiting reagents with the gene of interest.

To identify an ideal control gene for an assay, a number of genes were tested for variability between samples and expression in both mononuclear RNA samples and whole blood RNA samples using the RNA procurement and preparation methods and real-time PCR assays described above. 6 whole-blood and 6 mononuclear RNA samples from transplant recipients were tested. The intensity levels and variability of each gene in duplicate experiments on both sample types are shown in FIG. 11. Based on criteria of low variability and high expression across samples, β-actin, 18s, GAPDH, b2microglobulin were found to be good examples of control genes for the PAX samples. A single control gene may be incorporated as an internal biplex control is assays.

Controlling for Variation in Real Time PCR

Due to differences in reagents, experimenters, and preparation methods, and the variability of pipetting steps, there is significant plate-to-plate variation in real-time PCR experiments. This variation can be reduced by automation (to reduce variability and error), reagent lot quality control, and optimal data handling. However, the results on replicate plates are still likely to be different since they are run in the machine at different times.

Variation can also enter in data extraction and analysis. Real-time PCR results are measured as the time (measured in PCR cycles) at which the fluorescence intensity ($\Box$Rn in Applied Biosystems SDS v2.1 software) crosses a user-determined threshold (CT). When performing relative quantification, the CT value for the target gene is subtracted from the CT value for a control gene. This difference, called ΔCT, is the value compared among experiments to determine whether there is a difference between samples. Variation in setting the threshold can introduce additional error. This is especially true in the duplexed experimental format, where both the target gene and the control gene are measured in the same reaction tube. Duplexing is performed using dyes specific to each of the two genes. Since two different fluorescent dyes are used on the plate, two different thresholds are set. Both of these thresholds contribute to each ΔCT. Slight differences in the each dye's threshold settings (relative to the other dye) from one plate to the next can have significant effects on the ΔCT.

There are several methods for setting the threshold for a PCR plate. Older versions of SDS software (Applied Biosystems) determine the average baseline fluorescence for the plate and the standard deviation of the baseline. The threshold is set to 10× the standard deviation of the baseline. In SDS 2.0 the users must set the baseline by themselves. Software from other machine manufacturers either requires the user to set the threshold themselves or uses different algorithms. The latest version of the SDS software (SDS 2.1) contains Automatic baseline and threshold setting. The software sets the baseline separately for each well on the plate using the ΔRn at cycles preceding detectable levels. Variability among plates is dependent on reproducible threshold setting. This requires a mathematical or experimental data driven threshold setting protocol. Reproducibly setting the threshold according to a standard formula will minimize variation that might be introduced in the threshold setting process. Additionally, there may be experimental variation among plates that can be reduced by setting the threshold to a component of the data. We have developed a system that uses a set of reactions on each plate that are called the threshold calibrator (TCb). The TCb wells are used to set the threshold on all plates.

1. The TCb wells contain a template, primers, and probes that are common among all plates within an experiment.

2. The threshold is set within the minimum threshold and maximum threshold determined above.

3. The threshold is set to a value in this range that results in the average CT value for the TCb wells to be the same on all plates.

These methods were used to derive the primers depicted in Table 2C.

Example 13

Real-Time PCR Expression Markers of Acute Allograft Rejection

In examples 14 and 16, genes were identified as useful markers of cardiac and renal allograft rejection using microarrays. Some genes identified through these studies are listed in Table 2. In order to validate these findings, obtain a more precise measurement of expression levels and develop PCR reagents for diagnostic testing, real-time PCR assays were performed on samples from allograft recipients using primers to the identified genes. Some gene specific PCR primers were developed and tested for all genes in Table 2A as described in example 12. Some primers are listed in Table 2C and the sequence listing. These primers were used to measure expression of the genes relative to β-actin or β-gus in 69 mononuclear RNA samples obtained from cardiac allograft recipients using Sybr green real-time PCR assays as described in example 12. Each sample was associated with an ISHLT cardiac rejection biopsy grade. The samples were tested in 2 phases. In phase I, 14 Grade 0, 1 Grade 1A, 3 Grade 2 and 9 Grade 3A samples were tested. In phase II, 19 Grade 2, 4 Grade 1B, 4 Grade 2 and 15 Grade 3A samples were tested. Data was analyzed for each phase individually and for the combined phase I+II sample set. These data are summarized in Table 6.

The average fold change in expression between rejection (3A) and no rejection (0) samples was calculated. A t-test was done to determine the significance with which each gene was differentially expressed between rejection and no rejection and a p-value was calculated. Genes with high average fold changes and low p-values are considered best candidates for further development as rejection markers. However, it is important to note that a gene with a low average fold change and a high p-value may still be a useful marker for rejection in some patients and may work as part of a gene expression panel to diagnose rejection. These same PCR data were used to create PCR gene expression panels for diagnosis of acute rejection as discussed in example 17.

Non-parametric tests such as the Fisher Exact Test and Mann-Whitney U test are useful for choosing useful markers. They assess the ability of markers to discriminate between different classes as well as their significance. For example, one could use the median of all samples (including both non-rejector and rejector samples) as a threshold and apply the Fisher Exact test to the numbers of rejectors and non-rejectors above and below the threshold.

These methods were used to generate the data in Table 2D.

Example 14

Identification of Diagnostic Nucleotide Sets for Diagnosis of Cardiac Allograft Rejection Using Microarrays Genes were identified which have expression patterns useful for the diagnosis and monitoring of acute cardiac allograft rejection. Further, sets of genes that work together in a diagnostic algorithm for allograft rejection were identified. Acute allograft rejection is a process that occurs in all solid organ transplantation including, heart, lung, liver, kidney, pancreas, pancreatic islet cell, intestine and others. Gene expression markers of acute cardiac rejection may be useful for diagnosis and monitoring of all allograft recipients. Patients, patient clinical data and patient samples used in the discovery of markers below were derived from a clinical study described in example 5.

The collected clinical data was used to define patient or sample groups for correlation of expression data. Patient groups were identified for comparison. ° For example, a patient group that possesses a useful or interesting clinical distinction, verses a patient group that does not possess the distinction. Measures of cardiac allograft rejection were derived from the clinical data to divide patients (and patient samples) into groups with higher and lower rejection activity over some period of time or at any one point in time. Such data were rejection grades as determined from histological reading of the cardiac biopsy specimens by a pathologist and data measuring progression of end-organ damage, including depressed left ventricular dysfunction (decreased cardiac output, decreased ejection fraction, clinical signs of low cardiac output) and usage of inotropic agents (Kobashigawa 1998).

Mononuclear RNA samples were collected and prepared from patients who had recently undergone a cardiac allograft transplantation using the protocol described in example 2. The allograft rejection status at the time of sample collection was determined by examination of cardiac biopsies as described in example 5 and as summarized here.

300 patient samples were included in the analysis. Each patient sample was associated with a biopsy and other clinical data collected at the time of the sample. The cardiac biopsies were graded by a pathologist at the local center and by three centralized pathologists who read the biopsy slides from all four local centers in a blinded manner. Biopsy grades included 0, 1A, 1B, 2, 3A, and 3B. No grade 4 rejection was identified. Dependent variables were developed based on these grades using the local center pathology reading, the reading of a centralized and blinded pathologist, the highest of the readings, local or centralized and a consensus grade derived from all pathological readings. Samples were classified as no rejection or rejection in the following ways: Grade 0 vs. Grades 14, Grades 0 and 1A vs. Grades 1B-4, Grade 0 vs. Grade 3A, Grade 0 vs. Grades 1B-4, and Grade 0 vs. Grades 1B and 3A-4. Grade 0 samples were selected such that they were not immediately followed by an episode of acute rejection in the same patient. Comparing Grade 0 samples to Grade 3A samples gives the greatest difference between the rejection and no rejection groups on average.

Taking the highest of all pathologist readings has the effect of removing any sample from the no rejection class that was not a unanimous Grade 0. It also results in an increase in the number of rejection samples used in an analysis with the assumption that if a pathologist saw features of rejection, the call was likely correct and the other pathologists may have missed the finding. Many leading cardiac pathologists and clinicians believe that ISHLT grade 2 rejection does not represent significant acute rejection. Thus, for correlation analysis, exclusion of Grade 2 samples may be warranted. Clinical data were also used to determine criteria for including samples in the analysis. For example, a patient with an active infection or in the early post-transplant period (ongoing surgical inflammation) might have immune activation unrelated to rejection and thus be difficult to identify as patients without rejection. The strictest inclusion criteria required that samples be from patients who did not have a bacterial or viral infection, were at least two weeks post cardiac transplant, were asymptomatic and were not currently admitted to the hospital.

After preparation of RNA (example 2), amplification, labeling, hybridization, scanning, feature extraction and data processing were done as described in Example 11, using the oligonucleotide microarrays described in Example 9. The resulting log ratio of expression of Cy3 (patient sample)/Cy5 (R50 reference RNA) was used for analysis.

Significance analysis for microarrays (SAM, Tusher 2001, Example 15) was used to discover genes that were differentially expressed between the rejection and no-rejection groups. Many different combinations of dependent variables, inclusion criteria, static/referenced, and data subsets were used in SAM analysis to develop the primary lists of genes significantly differentially expressed between rejection and no-rejection. As described in example 15, SAM assigns a false detection rate to each gene identified as differentially expressed. The most significant of these genes were identified. An exemplary analysis was the comparison of Grade 0 samples to Grade 3A-4 samples using SAM. Data from the all the pathological readings was used to identify consensus Grade 0 samples and samples with at least one reading of Grade 3A or above. Using this definition of rejection and no rejection, expression profiles from rejection samples were compared to no rejection samples using SAM. The analysis identified 7 genes with a FDR of 1%, 15 genes @1.4%, 35 genes @3.9%. Many more genes were identified at higher FDR levels.

In Table 7, a number of SAM analyses are summarized. In each case the highest grade from the 3 pathologists was taken for analysis. No rejection and rejection classes are defined. Samples are either used regardless of redundancy with respect to patients or a requirement is made that only one sample is used per patient or per patient per class. The number of samples used in the analysis is given and the lowest FDR achieved is noted.

Some of the genes identified by SAM as candidate rejection markers are noted in Table 2A and B. SAM chooses genes as significantly different based on the magnitude of the difference between the groups and the variation among the samples within each group. It is important to note that a gene which is not identified by SAM as differentially expressed between rejection and no rejection may still be a useful rejection marker because: 1. The microarray technology is not adequately sensitive to detect all genes expressed at low levels. 2. A gene might be a useful member of a gene expression panel in that it is a useful rejection marker only in a subset of patients. This gene may not be significantly differentially expressed between all rejection and no rejection samples.

For the purposes of cross-validation of the results, the datasets were also divided into subsets to compare analysis between two subsets of roughly half of the data. The types of subsets constructed were as follows. First half/second half subsets were the first half of the samples and the second half of the samples from a dataset ordered by sample number. Odd/even subsets used the same source, a dataset ordered by sample number, but the odd subset consisted of every $2^{nd}$ sample starting with the first and the even subset consisted of every $2^{nd}$ sample starting with the second sample, Center 14/other subsets were the same datasets, divided by transplant hospital. The center 14 subset consisted of all samples from patients at center 14, while the other subset consisted of all samples from the other three centers (12,13, and 15). When a gene was found to be significantly differentially expressed in both sets of data, a higher priority was put on that gene for development of a diagnostic test. This was reflected in a "Array Score" value (Table 2B) that also considered the false detection rate for the gene and the importance of the gene in classification models (see example 17).

Alternatively one can divide samples into 10 equal parts and do 10-fold cross validation of the results of SAM.

Microarray data was also used to generate classification models for diagnosis of rejection as described in example 17. Genes identified through classification models as useful in the diagnosis of rejection are noted in Table 2B in the column "models".

As genes were identified as useful rejection markers by microarray significance analysis, classification models, PCR analysis, or through searching the prior art, a variety of approaches were employed to discover genes that had similar expression behavior (coexpression) to the gene of interest. If a gene is a useful rejection marker, then a gene that is identified as having similar expression behavior is also likely to be a useful rejection marker. Hierarchical clustering (Eisen et al. 1998, see example 15) was used to identify co-expressed genes for established rejection markers. Genes were identified from the nearest branches of the clustering dendrogram. Gene expression profiles generated from 240 samples derived from transplant recipients were generated as described above. Hierarchical clustering was performed and co-expressed genes of rejection markers were identified. An example is shown in FIG. 12. SEQ ID NO:85 was shown to be significantly differentially expressed between rejection and no rejection using both microarrays and PCR. Gene SEQ ID NO:3020 was identified by hierarchical clustering as closely co-expressed with SEQ ID NO:85. In table 2B, genes identified as co-expressed with established markers are identified as such by listing the SEQ ID that they are co-expressed with in the column labeled "clusters".

Some of the primers for real-time PCR validation were designed for each of the marker genes as described in Example 12 and are listed in Table 2C and the sequence listing. PCR expression measurements using these primers were used to validate array findings, more accurately measure differential gene expression and create PCR gene expression panels for diagnosis of rejection as described in example 17.

Alternative methods of analyzing the data may involve 1) using the sample channel without normalization by the reference channel, 2) using an intensity-dependent normalization based on the reference which provides a greater correction when the signal in the reference channel is large, 3) using the data without background subtraction or subtracting an empirically derived function of the background intensity rather than the background itself.

These methods were used to identify genes listed in Table 2B.

Example 15

Correlation and Classification Analysis

After generation and processing of expression data sets from microarrays as described in Example 11, a log ratio value is used for most subsequent analysis. This is the logarithm of the expression ratio for each gene between sample and universal reference. The processing algorithm assigns a number of flags to data that are of low signal to noise, saturated signal or are in some other way of low or uncertain quality. Correlation analysis can proceed with all the data (including the flagged data) or can be done on filtered data sets where the flagged data is removed from the set. Filtered data should have less variability and noise and may result in more significant or predictive results. Flagged data contains all information available and may allow discovery of genes that are missed with the filtered data set. After filtering the data for quality as described above and in example 11, missing data are common in microarray data sets. Some algorithms don't require complete data sets and can thus tolerate missing values. Other algorithms are optimal with or require imputed values for missing data. Analysis of data sets with missing values can proceed by filtering all genes from the analysis that have more than 5%, 10%, 20%, 40%, 50%, 60% or other % of values missing across all samples in the analysis. Imputation of data for missing values can be done by a variety of methods such as using the row mean, the column mean, the nearest neighbor or some other calculated number. Except when noted, default settings for filtering and imputation were used to prepare the data for all analytical software packages.

In addition to expression data, clinical data are included in the analysis. Continuous variables, such as the ejection fraction of the heart measured by echocardiography or the white blood cell count can be used for correlation analysis. Any piece of clinical data collected on study subjects can be used in a correlation or classification analysis. In some cases, it may be desirable to take the logarithm of the values before analysis. These variables can be included in an analysis along with gene expression values, in which case they are treated as another "gene". Sets of markers can be discovered that work to diagnose a patient condition and these can include both genes and clinical parameters. Categorical variables such as male or female can also be used as variables for correlation analysis. For example, the sex of a patient may be an important splitter for a classification tree.

Clinical data are used as supervising vectors (dependent variables) for the significance or classification analysis of expression data. In this case, clinical data associated with the samples are used to divide samples in to clinically meaningful diagnostic categories for correlation or classification analysis. For example, pathologic specimens from kidney biopsies can be used to divide lupus patients into groups with and without kidney disease. A third or more categories can also be included (for example "unknown" or "not reported"). After generation of expression data and definition of supervising vectors, correlation, significance and classification analysis are used to determine which set of genes and set of genes are most appropriate for diagnosis and classification of patients and patient samples. Two main types of expression data analyses are commonly performed on the expression data with differing results and purposes. The first is significance analyses or analyses of difference. In this case, the goal of the analysis is to identify genes that are differentially expressed between sample groups and to assign a statistical confidence to those genes that are identified. These genes may be markers of the disease process in question and are further studied and developed as diagnostic tools for the indication. The second major type of analysis is classification analysis. While significance analysis identifies individual genes that are differentially expressed between sample groups, classification analysis identifies gene sets and an algorithm for their gene expression values that best distinguish sample (patient) groups. The resulting gene expression panel and algorithm can be used to create and implement a diagnostic test. The set of genes and the algorithm for their use as a diagnostic tool are often referred to herein as a "model". Individual markers can also be used to create a gene expression diagnostic model. However, multiple genes (or gene sets) are often more useful and accurate diagnostic tools.

Significance Analysis for Microarrays (SAM)

Significance analysis for microarrays (SAM) (Tusher 2001) is a method through which genes with a correlation between their expression values and the response vector are statistically discovered and assigned a statistical significance. The ratio of false significant to significant genes is the False Discovery Rate (FDR). This means that for each threshold there are some number of genes that are called significant, and the FDR gives a confidence level for this claim. If a gene is called differentially expressed between two classes by SAM, with a FDR of 5%, there is a 95% chance that the gene is actually differentially expressed between the classes. SAM will identify genes that are differentially expressed between the classes. The algorithm selects genes with low variance within a class and large variance between classes. The algorithm may not identify genes that are useful in classification, but are not differentially expressed in many of the samples. For example, a gene that is a useful marker for disease in women and not men, may not be a highly significant marker in a SAM analysis, but may be useful as part of a gene set for diagnosis of a multi-gene algorithm.

After generation of data from patient samples and definition of categories using clinical data as supervising vectors, SAM is used to detect genes that are likely to be differentially expressed between the groupings. Those genes with the highest significance can be validated by real-time PCR (Example 13) or can be used to build a classification algorithm as described here.

Classification

Classification algorithms are used to identify sets of genes and formulas for the expression levels of those genes that can be applied as diagnostic and disease monitoring tests. The same classification algorithms can be applied to all types of expression and proteomic data, including microarray and PCR based expression data. Examples of classification models are given in example 17. The discussion below describes the algorithms that were used and how they were used.

Classification and Regression Trees (CART) is a decision tree classification algorithm (Breiman 1984). From gene expression and or other data, CART can develop a decision tree for the classification of samples. Each node on the decision tree involves a query about the expression level of one or more genes or variables. Samples that are above the threshold go down one branch of the decision tree and samples that are not go down the other branch. Genes from expression data sets can be selected for classification building with CART by significant differential expression in SAM analysis (or other significance test), identification by supervised tree-harvesting analysis, high fold change between sample groups, or known relevance to classification of the target diseases. In addition, clinical data can be used as independent variables for CART that are of known importance to the clinical question or are found to be significant predictors by multivariate analysis or some other technique. CART identifies predictive variables and their associated decision rules for classification (diagnosis). CART also identifies surrogates for each splitter (genes that are the next best substitute for a useful gene in classification). Analysis is performed in CART by weighting misclassification costs to optimize desired performance of the assay. For example, it may be most important that the sensitivity of a test for a given diagnosis be >90%. CART models can be built and tested using 10 fold cross-validation or v-fold cross validation (see below). CART works best with a smaller number of variables (5-50). Multiple Additive Regression Trees (Friedman, J H 1999, MART) is similar to CART in that it is a classification algorithm that builds decision trees to distinguish groups. MART builds numerous trees for any classification problem and the resulting model involves a combination of the multiple trees. MART can select variables as it build models and thus can be used on large data sets, such as those derived from an 8000 gene microarray. Because MART uses a combination of many trees and does not take too much information from any one tree, it resists over training. MART identifies a set of genes and an algorithm for their use as a classifier.

A Nearest Shrunken Centroids Classifier can be applied to microarray or other data sets by the methods described by Tibshirani et al. 2002. This algorithms also identified gene sets for classification and determines their 10 fold cross validation error rates for each class of samples. The algorithm determines the error rates for models of any size, from one gene to all genes in the set. The error rates for either or both sample classes can are minimized when a particular number of genes are used. When this gene number is determined, the algorithm associated with the selected genes can be identified and employed as a classifier on prospective sample.

For each classification algorithm and for significance analysis, gene sets and diagnostic algorithms that are built are tested by cross validation and prospective validation. Validation of the algorithm by these means yields an estimate of the predictive value of the algorithm on the target population. There are many approaches, including a 10 fold cross validation analysis in which 10% of the training samples are left out of the analysis and the classification algorithm is built with the remaining 90%. The 10% are then used as a test set for the algorithm. The process is repeated 10 times with 10% of the samples being left out as a test set each time. Through this analysis, one can derive a cross validation error which helps estimate the robustness of the algorithm for use on prospective (test) samples. Any % of the samples can be left out for cross validation (v-fold cross validation, LOOCV). When a gene set is established for a diagnosis with an acceptable cross validation error, this set of genes is tested using samples that were not included in the initial analysis (test samples). These samples may be taken from archives generated during the clinical study. Alternatively, a new prospective clinical study can be initiated, where samples are obtained and the gene set is used to predict patient diagnoses.

Example 16

Acute Allograft Rejection: Biopsy Tissue Gene Expression Profiling

Acute allograft rejection involves activation of recipient leukocytes and infiltration into the rejecting organ. For example, CD8 T-cells are activated by CD4 T-cells and enter the allograft where they destroy graft tissue. These activated, graft-associated leukocytes may reside in the graft, die or exit the graft. Upon exiting, the cells can find their way into the urine or blood (in the case of renal allografts), bile or blood (liver allografts) or blood (cardiac allografts). These activated cells have specific gene expression patterns that can be measured using microarrays, PCR or other methods. These gene expression patterns can be measured in the graft tissue (graft associated leukocytes), blood leukocytes, urine leukocytes or stool/biliary leukocytes. Thus graft associated leukocyte gene expression patterns are used to discover markers of activated leukocytes that can be measured outside the graft for diagnostic testing.

Renal biopsy and cardiac biopsy tissue specimens were obtained for gene expression profiling. The specimens were obtained at the time of allograft biopsy and were preserved by flash freezing in liquid nitrogen using standard approaches or immersion in an RNA stabilization reagent as per the manufacturers recommendation (RNAlater, Qiagen, Valencia, Calif.). Biopsy allograft pathological evaluation was also obtained and samples were classified as having a particular ISHLT rejection grade (for cardiac) or acute rejection, chronic rejection, acute tubular necrosis or no disease (for renal).

28 renal biopsy tissue samples were transferred to RLT buffer, homogenized and RNA was prepared using RNeasy preparation kits (Qiagen, Valencia, Calif.). Average total RNA yield was 1.3 ug. Samples were subjected to on column DNAse digestion. 18 samples were derived from patients with ongoing acute allograft rejection and 10 were from controls with chronic rejection or acute renal failure.

RNA from the samples was used for amplification, labeling and hybridization to leukocyte arrays (example 11). Significance analysis for microarrays (SAM, Tusher 2001, Example 15) was used to identify genes that were differentially expressed between the acute rejection samples and controls. Leukocyte markers of acute rejection that are associated with the graft should be genes that are expressed at some level in activated leukocytes. Since leukocytes appear in graft tissue with some frequency with acute rejection, leukocyte genes associate with rejection are identified by SAM as upregulated in acute rejection in this experiment. 35 genes were identified as upregulated in acute rejection by SAM with less than a 5% false detection rate and 139 were detected with <10.0% FDR. Results of this analysis are shown in Table 8.

For each of these genes, to 50mer oligonucleotide sequence was used to search NCBI databases including Unigene and OMIM. Genes were identified by sequence analysis to be either known leukocyte specific markers, known leukocyte expressed markers, known not to be leukocyte expressed or expression unknown. This information helped selected candidate leukocyte markers from all upregulated genes. This is necessary because some of the upregulated genes may have been expressed by renal tissue. Those genes that are leukocyte specific or leukocyte expressed were selected for evaluation by PCR in urine and blood samples from patients with and without acute allograft rejection (cardiac and renal). These genes are useful expression markers of acute rejection in allograft tissue specimens and may also be useful gene expression markers for the process in circulating leukocytes, or urine leukocytes. Genes with known leukocyte expression are noted in Table 8. In addition, some of the leukocyte expressed genes from this analysis were selected for PCR validation and development for diagnosis of acute cardiac rejection and are noted in Table 2.

Five cardiac rejection markers in the peripheral blood were assayed using real-time PCR in renal biopsy specimens. The average fold change for these genes between acute rejection (n=6) and controls (n=6) is given below. Work is ongoing to increase the number of samples tested and the significance of the results.

PCR Assays of Cardiac Rejection Peripheral Blood Markers in Renal Allograft Tissue. R=Rejection, NR=No Rejection.

| Gene | Fold change (R/NR) |
|---|---|
| Granzyme B | 2.16 |
| CD20 | 1.42 |
| NK cell receptor | 1.72 |
| T-box 21 | 1.74 |
| IL4 | 1.3 |

Markers of renal rejection that are secreted from cells may be measured in the urine or serum of patients as a diagnostic or screening assay for rejection. Genes with lower molecular weight are most likely to be filtered into the urine to be measured in this way. Standard immunoassays may be used to measure these proteins. In table 8, genes that are known to be secreted are noted.

Example 17

Microarray and PCR Gene Expression Panels for Diagnosis and Monitoring of Acute Allograft Rejection Array Panels/Classification Models Using the methods of the invention, gene expression panels were discovered for screening and diagnosis of acute allograft rejection. Gene expression panels can be implemented for diagnostic testing using any one of a variety of technologies, including, but not limited to, microarrays and real-time PCR.

Using peripheral blood mononuclear cell RNA that was collected and prepared from cardiac allograft recipients as described in examples 2 and 5, leukocyte gene expression profiles were generated and analyzed using microarrays as described in examples 11, 13, and 15. 300 samples were analyzed. ISHLT rejection grades were used to divide patients into classes of rejection and no rejection. Multiple Additive Regression Trees (MART, Friedman, J H 1999, example 15) was used to build a gene expression panel and algorithm for the diagnosis of rejection with high sensitivity. Default settings for the implementation of MART called TreeNet 1.0 (Salford Systems, San Diego, Calif.) were used except where noted.

82 Grade 0 (rejection) samples and 76 Grade 1B-4 (no rejection) samples were divided into training (80% of each class) and testing (20% of each class) sets. A MART algorithm was then developed on the training set to distinguish rejection from no rejection samples using a cost of 1.02:1 for misclassification of rejection as no rejection. The resulting algorithm was then used to classify the test samples. The algorithm correctly classified 51 of 66 (77%) no rejection samples in the training set and 9 of 16 (56%) no rejection samples in the test set. For rejection samples 64 of 64 (100%) were correctly classified in the training set and 12 of 12 were correctly classified in the test set. The algorithm used 37 genes. MART ranks genes by order of importance to the model. In order, the 37 genes were: SEQ IDs: 3058, 3030, 3034, 3069, 3081, 3072, 3041, 3052, 3048, 3045, 3059, 3075, 3024, 279, 3023, 3053, 3022, 3067, 3020, 3047, 3033, 3068, 3060, 3063, 3028, 3032, 3025, 3046, 3065, 3080, 3039, 3055, 49, 3080, 3038, 3071.

Another MART model was built by excluding samples derived from patients in the first month post transplant and from patients with known CMV infection. 20 Grade 0 (rejection) samples and 25 Grade 1B-4 (no rejection) samples were divided into training (80% of each class) and testing (20% of each class) sets. A MART algorithm was then developed on the training set to distinguish rejection from no rejection samples using default settings. The resulting algorithm was then used to classify the test samples. The algorithm correctly classified 100% of samples of both classes in the training and testing sets. However, this model required 169 genes. The sample analysis was done a second time with the only difference being requirement that all decision trees in the algorithm be composed of two nodes (single decision, "stump model"). In this case 15/16 no rejection samples were correctly identified in the training set and 4/4 no rejection samples were correctly identified in the test set. For the rejection samples, 17/19 were correctly identified in the training set and 5/6 were correctly classified in the test set. This model required 23 genes. In order of importance, they were: SEQ IDs: 3042, 2783, 3076, 3029, 3026, 2751, 3036, 3073, 3035, 3050, 3051, 3027, 3074, 3062, 3044, 3077, 2772, 3049, 3043, 3079, 3070, 3057, 3078.

Real-Time PCR Panels/Classification Models

PCR primers were developed for top rejection markers and used in real-time PCR assays on transplant patient samples as described in examples 12 and 13. This data was used to build PCR gene expression panels for diagnosis of rejection. Using MART (example 15) a 10-fold cross validated model was created to diagnose rejection using 12 no rejection samples (grade 0) and 10 rejection samples (grade 3A). Default settings were used with the exception of assigning a 1.02:1 cost for misclassification of rejection as no rejection and requirement that all decision trees be limited to 2 nodes ("stump model"). 20 genes were used in the model, including: SEQ IDs:101, 3021, 102, 2781, 78, 87, 86, 36, 77, 2766, 3018, 80, 3019, 2752, 79, 99, 3016, 2790, 3020, 3056, 88. The 10-fold cross-validated sensitivity for rejection was 100% and the specificity was 85%. Some PCR primers for the genes are listed in Table 2C and the sequence listing.

A different analysis of the PCR data was performed using the nearest shrunken centroids classifier (Tibshirani et al. 2002; PAM version 1.01, see example 15). A 10-fold cross validated model was created to diagnose rejection using 13 no rejection samples (grade 0) and 10 rejection samples (grade 3A). Default settings were used with the exception of using a prior probability setting of (0.5, 0.5). The algorithm derives algorithms using any number of the genes. A 3-gene model was highly accurate with a 10 fold cross-validated sensitivity for rejection of 90%, and a specificity of 85%.

The 3 genes used in this model were: SEQ IDs 2784, 79, and 2794. Some of the PCR primers used are given in Table 2C and the sequence listing. An ROC curve was plotted for the 3-gene model and is shown in FIG. 13.

Example 18

Assay Sample Preparation

In order to show that XDx's leukocyte-specific markers can be detected in whole blood, we collected whole blood RNA using the PAXgene whole blood collection, stabilization, and RNA isolation kit (PreAnalytix). Varying amounts of the whole blood RNA were used in the initial RT reaction (1, 2, 4, and 8 ug), and varying dilutions of the different RT reactions were tested (1:5, 1:10, 1:20, 1:40, 1:80, 1:160). We did real-time PCR assays with primers specific to XDx's markers and showed that we can reliably detect these markers in whole blood.

Total RNA was prepared from 14 mononuclear samples (CPT, BD) paired with 14 whole blood samples (PAXgene, PreAnalytix) from transplant recipients. cDNA was prepared from each sample using 2 ug total RNA as starting material. Resulting cDNA was diluted 1:10 and Sybr green real-time PCR assays were performed.

For real-time PCR assays, Ct values of 15-30 are desired for each gene. If a gene's Ct value is much above 30, the result may be variable and non-linear. For PAX sample, target RNA will be more dilute than in CPT samples. cDNA dilutions must be appropriate to bring Ct values to less than 30. Ct values for the first 5 genes tested in this way are shown in the table below for both whole blood RNA (PAX) and mononuclear RNA (CPT).

| Gene | Ct PAX | Ct CPT |
| --- | --- | --- |
| CD20 | 27.41512 | 26.70474 |
| 4761 | 28.45656 | 26.52635 |
| 3096 | 29.09821 | 27.83281 |
| GranzymeB | 31.18779 | 30.56954 |
| IL4 | 33.11774 | 34.8002 |
| Actin | 19.17622 | 18.32966 |
| B-GUS | 26.89142 | 26.92735 |

With one exception, the genes have higher Ct values in whole blood. Using this protocol, all genes can be detected with Cts<35. For genes found to have Ct values above 30 in target samples, less diluted cDNA may be needed.

Example 19

Allograft Rejection Diagnostic Gene Sequence Analysis

Gene products that are secreted from cells or expressed as surface proteins have special diagnostic utility in that an assay may be developed to detect relative quantities of proteins in blood plasma or serum. Secreted proteins may also be detectable in urine, which may be a useful sample for the detection of rejection in renal allograft recipients. Cell surface markers may be detected using antigen specific antibodies in ELISA assays or using flow sorting techniques such as FACS.

Each gene that is found to be differentially regulated in one population of patients has several potential applications. It may be a target for new pharmaceuticals, a diagnostic marker for a condition, a benchmark for titrating drug delivery and clearance, or used in screening small molecules for new therapeutics. Any of these applications may be improved by an understanding of the physiologic function and localization of the gene product in vivo and by relating those functions to known diseases and disorders. Identifying the basic function of each candidate gene helps identify the signaling or metabolic pathways the gene is a part of, leading us to investigate other members of those pathways as potential diagnostic markers or targets of interest to drug developers.

For each of the markers in table 2, we attempted to identify the basic function and subcellular localization of the gene. These results are summarized in Table 9. In addition to initial DNA sequencing and processing, sequence analysis, and analysis of novel clones, information was obtained from the following public resources: Online Mendelian Inheritance in Man at the NCBI, LocusLink at the NCBI, the SWISS-PROT database, and Protein Reviews on the Web. For each marker represented by a curated reference mRNA from the RefSeq project, the corresponding reference protein accession number is listed. Curated sequences are those that have been manually processed by NCBI staff to represent the best estimate of the mRNA sequence as it is transcribed, based on alignments of draft DNA sequence, predicted initiation, termination and splice sites, and submissions of EST and full-length mRNA sequences from the scientific community.

These methods were used to derive the data in Table 2E.

Example 20

Detection of Proteins Expressed by Diagnostic Gene Sequences

One of ordinary skill in the art is aware of many possible methods of protein detection. The following example illustrates one possible method.

The designated coding region of the sequence is amplified by PCR with adapter sequences at either end for subcloning. An epitope or other affinity "tag" such as a "His-tag" may be added to facilitate purification and/or detection of the protein. The amplified sequence is inserted into an appropriate expression vector, most typically a shuttle vector which can replicate in either bacteria, most typically E. coli, and the organism/cell of choice for expression such as a yeast or mammalian cell. Such shuttle vectors typically contain origins of replication for bacteria and an antibiotic resistance marker for selection in bacteria, as well as the relevant replication and selection sequences for transformation/transfection into the ultimate expression cell type. In addition, the sequence of interest is inserted into the vector so that the signals necessary for transcription (a promoter) and translation operably linked to the coding region. Said expression could be accomplished in bacteria, fungi, or mammalian cells, or by in vitro translation.

The expression vector would then typically be used to transform bacteria and clones analyzed to ensure that the proper sequence had been inserted into the expression vector in the productive orientation for expression. Said verified expression vector is then transfected into a host cell and transformants selected by a variety of methods including antibiotic resistance or nutritional complementation of an auxotrophic marker. Said transformed cells are then grown under conditions conducive to expression of the protein of interest, the cells and conditioned media harvested, and the protein of interest isolated from the most enriched source, either the cell pellet or media.

The protein is then be isolated by standard of chromatographic or other methods, including immunoaffinity chromatography using the affinity "tag" sequence or other methods, including cell fractionation, ion exchange, size exclusion chromatography, or selective precipitation. The isolated and purified protein is then be used as an antigen to generate specific antibodies. This is accomplished by standard methods including injection into heterologous species with an adjuvant, isolation of monoclonal antibodies from mice, or in vitro selection of antibodies from bacteriophage display antibody libraries. These antibodies are then used to detect the presence of the indicated protein of interest in a complex bodily fluid using standard methods such as ELISA or RIA.

Example 21

Detecting Changes in the Rate of Hematopoiesis

Gene expression profiling of blood cells from cardiac allograft recipients was done using microarrays and real-time PCR as described in other examples herein.

Two of the genes in that were most correlated with cardiac transplant acute rejection with both microarrays and PCR were hemoglobin Beta and 2,3 DPGM. These genes are well know to be specific markers of erythrocyte lineages. This correlation was found using both purified peripheral mononuclear cells and whole blood RNA preparations.

Analysis of the five genes from the PCR data most strongly correlated with rejection showed that their expression levels were extremely highly correlated within each other (R2>0.85).

| Gene | Hs | Acc | SEQ ID No |
|---|---|---|---|
| hemoglobin, beta (HB B) | Hs.155376 | NM_000518 | 86 |
| 2,3-bisphosphoglycerate mutase (BPC) | Hs.198365 | X04327 | 87 |
| cDNA FLJ20347 | Hs.102669 | AK000354 | 94 |
| 602620663F1cDNA | Hs.34549 | AI123826 | 107 |
| HA 1247 cDNA | Hs.33757 | AI114652 | 91 |

This suggested that they were all elevated as part of a single response or process. When the microarray data was used to cluster these genes with each other and the other genes on the microarray, we found that these five genes clustered reasonably near each and of the other array genes which clustered tightly with them, four of the top 40 or so were platelet related genes. In addition, these a number of these genes clustered closely with CD34. CD34 is a marker of hematopoietic stem cells and is seen in the peripheral blood with increased hematopoiesis.

CD34, platelet RNA and erythrocyte RNA all mark immature or progenitor blood cells and it is clear that theses marker of acute rejection are part of a coordinated hematopoietic response. A small increase in the rate of production of RBCs and platelets may result in large fold changes in RNA levels. Immune activation from acute rejection may lead to increased hematopoiesis in the bone marrow and non-marrow sites. This leads to an increase in many lineages because of the lack of complete specificity of the marrow response. Alternatively, increased hematopoiesis may occur in a transplant recipient due to an infection (viral or other), allergy or other stimulus to the system. This results in production of cells or a critical mass of immune cells that can cause rejection. In this scenario, monitoring for markers of immune activation would provide an opportunity for early diagnosis.

TABLE 1

| Disease Classification | Disease/Patient Group |
|---|---|
| Cardiovascular Disease | Atherosclerosis |
| | Unstable angina |
| | Myocardial Infarction |
| | Restenosis after angioplasty |
| | Congestive Heart Failure |
| | Myocarditis |
| | Endocarditis |
| | Endothelial Dysfunction |
| | Cardiomyopathy |
| | Cardiovascular drug use |
| Infectious Disease | Hepatitis A, B, C, D, E, G |
| | Malaria |
| | Tuberculosis |
| | HIV |
| | Pneumocystis Carinii |
| | Giardia |
| | Toxoplasmosis |
| | Lyme Disease |
| | Rocky Mountain Spotted Fever |
| | Cytomegalovirus |
| | Epstein Barr Virus |
| | Herpes Simplex Virus |
| | Clostridium Dificile Colitis |
| | Meningitis (all organisms) |
| | Pneumonia (all organisms) |
| | Urinary Tract Infection (all organisms) |
| | Infectious Diarrhea (all organisms) |
| | Anti-infectious drug use |
| Angiogenesis | Pathologic angiogenesis |
| | Physiologic angiogenesis |
| | Treatment induced angiogenesis |
| | Pro or anti-angiogenic drug use |
| Transplant Rejection | Heart |
| | Lung |
| | Liver |
| | Pancreas |
| | Bowel |
| | Bone Marrow |
| | Stem Cell |
| | Graft versus host disease |
| | Transplant vasculopathy |
| | Skin |
| | Cornea |
| | Islet Cells |
| | Kidney |
| | Xenotransplants |
| | Mechanical Organ |
| | Immunosupressive drug use |
| Hematological Disorders | Anemia - Iron Deficiency |
| | Anemia - B12, Folate deficiency |
| | Anemia - Aplastic |
| | Anemia - hemolytic |
| | Anemia - Renal failure |
| | Anemia - Chronic disease |
| | Polycythemia rubra vera |
| | Pernicious anemia |
| | Idiophic Thrrombocytopenic purpura |
| | Thrombotic Thrombocytopenic purpura |
| | Essential thrombocytosis |
| | Leukemia |
| | Cytopenias due to immunosupression |
| | Cytopenias due to Chemotherapy |
| | Myelodysplasia |

TABLE 2A

| Gene | Gene Name | SEQ ID 50mer | HS | ACC | SEQ ID RNA/cDNA |
|---|---|---|---|---|---|
| HSRRN18S | 18S ribosomal RNA | 1 | NA | X03205 | 333 |
| ACTB | Actin, beta | 2 | Hs.288061 | NM_001101 | 334 |
| GUSB | Glucuronidase, beta | 3 | Hs.183868 | NM_000181 | 335 |
| B2M | beta 2 microglobulin | 4 | Hs.75415 | NM_004048 | 336 |
| TSN | Translin | 5 | Hs.75066 | NM_004622 | 337 |
| CCR7 | 1707 | 6 | Hs.1652 | NM_001838 | 338 |
| IL1R2 | 4685-IL1R | 7 | Hs.25333 | NM_004633 | 339 |
| AIF-1 | Allograft inflammatory factor 1, all variants | 8 | Hs.76364 | NM_004847 | 340 |
| ALAS2 | ALAS2 | 9 | Hs.323383 | NM_000032.1 | 341 |
| APELIN | APELIN | 10 | Hs.303084 | NM_017413 | 342 |

TABLE 2A-continued

| | | | | | |
|---|---|---|---|---|---|
| CD80 | B7-1, CD80 | 11 | Hs.838 | NM_005191 | 343 |
| EPB41 | Band 4.1 | 12 | Hs.37427 | NM_004437 | 344 |
| CBLB | c-cbl-B | 13 | Hs.3144 | NM_004351 | 345 |
| CCR5 | CCR5 | 14 | Hs.54443 | NM_000579 | 346 |
| MME | CD10 | 15 | Hs.1298 | NM_000902 | 347 |
| KLRC1 | CD159a | 16 | Hs.74082 | NM_002259 | 348 |
| FCGR3A | CD16 | 17 | Hs.176663 | NM_000569 | 349 |
| FCGR3B | CD16b | 18 | Hs.372679 | NM_000570 | 350 |
| LAG3 | CD223 | 19 | Hs.74011 | NM_002286 | 351 |
| PECAM1 | CD31 | 20 | Hs.78146 | NM_000442 | 352 |
| CD34 | CD34 | 21 | Hs.374990 | NM_001773 | 353 |
| FCGR1A | CD64 | 22 | Hs.77424 | NM_000566 | 354 |
| TFRC | CD71 = T9, transferrin receptor | 23 | Hs.77356 | NM_003234 | 355 |
| CMA1 | chymase | 24 | Hs.135626 | NM_001836 | 356 |
| KIT | c-Kit | 25 | Hs.81665 | NM_000222 | 357 |
| MPL | c-mpl | 26 | Hs.84171 | NM_005373 | 358 |
| EphB6 | EphB6 | 27 | Hs.3796 | NM_004445 | 359 |
| EPOR | EPO-R | 28 | Hs.127826 | NM_000121.2 | 360 |
| Foxp3 | Foxp3 | 29 | Hs.247700 | NM_014009 | 361 |
| GATA1 | GATA1 | 30 | Hs.765 | NM_002049 | 362 |
| ITGA2B | GP IIb | 31 | NM_000419.2 | NM_000419 | 363 |
| GNLY | granulysin | 32 | Hs.105806 | NM_006433 | 364 |
| GZMA | GZMA | 33 | Hs.90708 | NM_006144 | 365 |
| HBA | hemoglobin, alpha 1 | 34 | Hs.398636 | NM_000558.3 | 366 |
| HBZ | hemoglobin, zeta | 35 | Hs.272003 | NM_005332.2 | 367 |
| HBB | hemoglobin, beta | 36 | Hs.155376 | NM_000518.4 | 368 |
| HBD | hemoglobin, delta | 37 | Hs.36977 | NM_000519.2 | 369 |
| HBE | hemoglobin, epsilon 1 | 38 | Hs.117848 | NM_005330 | 370 |
| HBG | hemoglobin, gamma A | 39 | Hs.283108 | NM_000559.2 | 371 |
| HBQ | hemoglobin, theta 1 | 40 | Hs.247921 | NM_005331 | 372 |
| HLA-DP | MH/c, class II, DP alpha 1 | 41 | Hs.198253 | NM_033554 | 373 |
| HLA-DQ | MHC, class II, DQ alpha 1 | 42 | Hs.198253 | NM_002122 | 374 |
| HLA-DRB | MHC, class II, DR beta 1 | 43 | Hs.375570 | NM_002124.1 | 375 |
| ICOS | ICOS | 44 | Hs.56247 | NM_012092 | 376 |
| IL18 | IL18 | 45 | Hs.83077 | NM_001562 | 377 |
| IL3 | interleukin 3 (colony-stimulating factor, multiple) | 46 | Hs.694 | NM_000588 | 378 |
| ITGA4 | Integrin, alpha 4 (antigen CD49D, alpha 4 subunit of VLA-4 receptor) | 47 | Hs.40034 | NM_000885 | 379 |
| ITGAM | integrin, alpha M (complement component receptor 3, alpha; also known as CD11b (p170), macrophage antigen alpha polypeptide) | 48 | Hs.172631 | NM_000632 | 380 |
| ITGB7 | integrin, beta 7 | 49 | Hs.1741 | NM_000889 | 381 |
| CEBPB | LAP, CCAAT/enhancer binding protein (C/EBP), beta | 50 | Hs.99029 | NM_005194 | 382 |
| NF-E2 | NF-E2 | 51 | Hs.75643 | NM_006163 | 383 |
| PDCD1 | programmed cell death 1, PD-1 | 52 | Hs.158297 | NM_005018 | 384 |
| PF4 | platelet factor 4 (chemokine (C-X-C motif) ligand 4) | 53 | Hs.81564 | NM_002619 | 385 |
| PRKCQ | protein kinase C, theta | 54 | Hs.211593 | NM_006257.1 | 386 |
| PPARGC1 | PPARgamma | 55 | Hs.198468 | NM_013261 | 387 |
| RAG1 | recombination activating gene 1 | 56 | Hs.73958 | NM_000448 | 388 |
| RAG2 | recombination activating gene 2 | 57 | Na | NM_000536 | 389 |
| CXCL12 | chemokine (C-X-C motif) ligand 12 (stromal cell-derived factor 1) (SDF-1) | 58 | Hs.237356 | NM_000609 | 390 |
| TNFRSF4 | tumor necrosis factor receptor superfamily, member 4 | 59 | Hs.129780 | NM_003327 | 391 |
| TNFSF4 | tumor necrosis factor (ligand) superfamily, member 4 (tax-transcriptionally activated glycoprotein 1, 34kDa) | 60 | Hs.181097 | NM_003326 | 392 |
| TPS1 | tryptase, alpha | 61 | Hs.334455 | NM_003293 | 393 |
| ADA | ADA adenosine deaminase | 62 | Hs.1217 | NM_000022 | 394 |
| CPM | Carboxypeptidase M | 63 | Hs.334873 | NM_001874.1 | 395 |
| CSF2 | colony stimulating factor, GM-CSF | 64 | Hs.1349 | NM_000758.2 | 396 |
| CSF3 | colony stimulating factor 3, G-CSF | 65 | Hs.2233 | NM_172219 | 397 |
| CRP | C-reactive protein, pentraxin-related (CRP), | 66 | Hs.76452 | NM_000567.1 | 398 |
| FLT3 | FMS-Related Tyrosine Kinase 3 | 67 | Hs.385 | NM_004119 | 399 |
| GATA3 | GATA binding protein 3 | 68 | Hs.169946 | NM_002051.1 | 400 |
| IL7R | Interleukin 7 receptor | 69 | Hs.362807 | NM_002185.1 | 401 |
| KLF1 | Kruppel-like factor 1 (erythroid), EKLF | 70 | Hs.37860 | NM_006563.1 | 402 |
| LCK | lymphocyte-specific protein tyrosine kinase | 71 | Hs.1765 | NM_005356.2 | 403 |

TABLE 2A-continued

| | | | | | |
|---|---|---|---|---|---|
| LEF1 | lymphoid enhancer-binding factor 1 | 72 | Hs.44865 | NM_016269.2 | 404 |
| PLAUR | Urokinase-type Plasminogen Activator Receptor, CD87, uPAR | 73 | Hs.179657 | NM_002659.1 | 405 |
| TNFSF13B | Tumor necrosis factor (ligand) superfamily, member 13b, BlyS/TALL-1/BAFF | 74 | Hs.270737 | NM_006573.3 | 406 |
| IL8 | Interleukin 8 | 75 | Hs.624 | NM_000584 | 407 |
| GZMB | Granzyme B (granzyme 2, cytotoxic T-lymphocyte-associated serine esterase 1) | 76 | Hs.1051 | NM_004131 | 408 |
| TNFSF6 | Tumor necrosis factor (ligand) superfamily, member 6 | 77 | Hs.2007 | NM_000639 | 409 |
| TCIRG1 | T-cell, immune regulator 1, ATPase, H+ transporting, lysosomal V0 protein a isoform 3 | 78 | Hs.46465 | NM_006019 | 410 |
| PRF1 | Perforin 1 (pore forming protein) | 79 | Hs.2200 | NM_005041 | 411 |
| IL4 | Interleukin 4 | 80 | Hs.73917 | NM_000589 | 412 |
| IL13 | Interleukin 13 | 81 | Hs.845 | NM_002188 | 413 |
| CTLA4 | Cytotoxic T-lymphocyte-associated protein 4 | 82 | Hs.247824 | NM_005214 | 414 |
| CD8A | CD8 antigen, alpha polypeptide (p32) | 83 | Hs.85258 | NM_001768 | 415 |
| BY55 | Natural killer cell receptor, immunoglobulin superfamily member | 84 | Hs.81743 | NM_007053 | 416 |
| OID_4460 | EST | 85 | Hs.205159 | AF150295 | 417 |
| HBB | Hemoglobin, beta | 86 | Hs.155376 | NM_000518 | 418 |
| BPGM | 2,3-bisphosphoglycerate mutase | 87 | Hs.198365 | NM_001724 | 419 |
| MTHFD2 | Methylene tetrahydrofolate dehydrogenase (NAD+ dependent), methenyltetrahydrofolate cyclohydrolase | 88 | Hs.154672 | NM_006636 | 420 |
| TAP1 | Transporter 1, ATP-binding cassette, sub-family B (MDR1/TAP) | 89 | Hs.352018 | NM_000593 | 421 |
| KPNA6 | Karyopherin alpha 6 (importin alpha 7) | 90 | Hs.301553 | AW021037 | 422 |
| OID_4365 | Mitochondrial solute carrier | 91 | Hs.300496 | AI114652 | 423 |
| IGHM | Immunoglobulin heavy constant mu | 92 | Hs.300697 | BC032249 | 424 |
| OID_573 | KIAA1486 protein | 93 | Hs.210958 | AB040919 | 425 |
| OID_873 | KIAA1892 protein | 94 | Hs.102669 | AK000354 | 426 |
| OID_3 | EST | 95 | Hs.104157 | AW968823 | 427 |
| CXCR4 | Chemokine (C-X-C motif) receptor 4 | 96 | Hs.89414 | NM_003467 | 428 |
| CD69 | CD69 antigen (p60, early T-cell activation antigen) | 97 | Hs.82401 | NM_001781 | 429 |
| CCL5 | Chemokine (C-C motif) ligand 5 (RANTES, SCYA5) | 98 | Hs.241392 | NM_002985 | 430 |
| IL6 | Interleukin 6 | 99 | Hs.93913 | NM_000600 | 431 |
| IL2 | Interleukin 2 | 100 | Hs.89679 | NM_000586 | 432 |
| KLRF1 | Killer cell lectin-like receptor subfamily F, member 1 | 101 | Hs.183125 | NM_016523 | 433 |
| LYN | v-yes-1 Yamaguchi sarcoma viral related oncogene homolog | 102 | Hs.80887 | NM_002350 | 434 |
| IL2RA | Interleukin 2 receptor, alpha | 103 | Hs.1724 | NM_000417 | 435 |
| CCL4 | Chemokine (C-C motif) ligand 4, SCYA4 | 104 | Hs.75703 | NM_002984 | 436 |
| OID_6207 | EST | 105 | Hs.92440 | D20522 | 437 |
| ChGn | Chondroitin beta 1,4 N-acetylgalactosaminyltransferase | 106 | Hs.11260 | NM_018371 | 438 |
| OID_4281 | EST | 107 | Hs.34549 | AA053887 | 439 |
| CXCL9 | Chemokine (C-X-C motif) ligand 9 (MIG) | 108 | Hs.77367 | NM_002416 | 440 |
| CXCL10 | Chemokine (C-X-C motif) ligand 10, SCYB10 | 109 | Hs.2248 | NM_001565 | 441 |
| IL17 | Interleukin 17 (cytotoxic T-lymphocyte-associated serine esterase 8) | 110 | Hs.41724 | NM_002190 | 442 |
| IL15 | Interleukin 15 | 111 | Hs.168132 | NM_000585 | 443 |
| IL10 | Interleukin 10 | 112 | Hs.193717 | NM_000572 | 444 |
| IFNG | Interferon, gamma | 113 | Hs.856 | NM_000619 | 445 |
| HLA-DRB1 | Major histocompatibility complex, class 11, DR beta 1 | 114 | Hs.308026 | NM_002124 | 446 |
| CD8B1 | CD8 antigen, beta polypeptide 1 (p37) | 115 | Hs.2299 | NM_004931 | 447 |
| CD4 | CD4 antigen (p55) | 116 | Hs.17483 | NM_000616 | 448 |
| CXCR3 | Chemokine (C-X-C motif) receptor 3, GPR9 | 117 | Hs.198252 | NM_001504 | 449 |
| OID_7094 | XDx EST 479G12 | 118 | NA | NA | 450 |
| OID_7605 | EST | 119 | Hs.109302 | AA808018 | 451 |
| CXCL1 | Chemokine (C-X-C motif) ligand 1 (melanoma growth stimulating activity, alpha) | 120 | Hs.789 | NM_001511 | 452 |

TABLE 2A-continued

| | | | | | |
|---|---|---|---|---|---|
| OID_253 | EST | 121 | Hs.83086 | AK091125 | 453 |
| GPI | Glucose phosphate isomerase | 122 | Hs.409162 | NM_000175 | 454 |
| CD47 | CD47 antigen (Rh-related antigen, integrin-associated signal transducer) | 123 | Hs.82685 | NM_001777 | 455 |
| HLA-F | Major histocompatibility complex, class I, F | 124 | Hs.377850 | NM_018950 | 456 |
| OID_5350 | EST | 125 | Hs.4283 | AK055687 | 457 |
| TCRGC2 | T cell receptor gamma constant 2 | 126 | Hs.112259 | M17323 | 458 |
| OID_7016 | EST | 127 | NA | B1018696 | 459 |
| PTGS2 | Prostaglandin-endoperoxide synthase 2 (prostaglandin G/H synthase and cyclooxygenase) | 128 | Hs.196384 | NM_000963 | 460 |
| OID_5847 | Hypothetical protein FLJ32919 | 129 | Hs.293224 | NM_144588 | 461 |
| PRDM1 | PR domain containing 1,with ZNF domain | 130 | Hs.388346 | NM_001198 | 462 |
| CKB | Creatine kinase, Brain | 131 | Hs.173724 | NM_001823 | 463 |
| TNNI3 | Troponin I, cardiac | 132 | Hs.351382 | NM_000363 | 464 |
| TNNT2 | Troponin T2, cardiac | 133 | Hs.296865 | NM_000364 | 465 |
| MB | Myoglobin | 134 | Hs.118836 | NM_005368 | 466 |
| SLC7A11 | Solute carrier family 7, (cationic amino acid transporter, y+ system) member 11 | 135 | Hs.6682 | NM_014331 | 467 |
| TNFRSF5 | tumor necrosis factor receptor superfamily, member 5; CD40 | 136 | Hs.25648 | NM_001250 | 468 |
| TNFRSF7 | tumor necrosis factor receptor superfamily, member 7; CD27 | 137 | Hs.355307 | NM_001242 | 469 |
| CD86 | CD86 antigen (CD28 antigen ligand 2, B7-2 antigen) | 138 | Hs.27954 | NM_175862 | 470 |
| AIF1v2 | Allograft inflammatory factor 1, splice valiant 2 | 139 | Hs.76364 | NM_004847 | 471 |
| EBV BCLF-1 | BCLF-1 major capsid | 140 | NA | AJ507799 | 472 |
| EBV EBV | EBNA repetitive sequence | 141 | NA | AJ507799 | 473 |
| CMV p67 | pp67 | 142 | NA | X17403 | 474 |
| CMV TRL7 | c6843-6595 | 143 | NA | X17403 | 475 |
| CMV IE1e3 | IE1 exon3 | 144 | NA | X17403 | 476 |
| CMV IE1e4 | IE1 exon 4 (40 variants) | 145 | NA | X17403 | 477 |
| EBV EBNA-1 | EBNA-1 coding region | 146 | NA | AJ507799 | 478 |
| EBV BZLF-1 | Zebra gene | 147 | NA | AJ507799 | 479 |
| EBV EBN | EBNA repetitive sequence | 148 | NA | AJ507799 | 480 |
| EBV EBNA-LP | Short EBNA leader peptide exon | 149 | NA | AJ507799 | 481 |
| CMV IE1 | IE1S | 150 | NA | X17403 | 482 |
| CMV IE1 | IE1-MC (exon3) | 151 | NA | X17403 | 483 |
| CLC | Charot-Leyden crystal protein | 152 | Hs.889 | NM_001828 | 484 |
| TERF2IP | telomeric repeat binding factor 2, interacting protein | 153 | Hs.274428 | NM_018975 | 485 |
| HLA-A | Major histocompatibility complex, class I, A | 154 | Hs.181244 | NM_002116 | 486 |
| OID_5891 | EST 3' end | 155 | None | AW297949 | 487 |
| MSCP | mitochondrial solute carrier protein | 156 | Hs.283716 | NM_018579 | 488 |
| DUSP5 | dual specificity phosphatase 5 | 157 | Hs.2128 | NM_004419 | 489 |
| PRO1853 | Hypothetical protein PRO1853 | 158 | Hs.433466 | NM_018607 | 490 |
| OID_6420 | 73A7, FLJ00290 protein | 159 | Hs.98531 | AK090404 | 491 |
| CDSN | Corneodesmosin | 160 | Hs.507 | NM_001264 | 492 |
| OID_4269 | EST | 161 | Hs.44628 | BM727677 | 493 |
| RPS25 | Ribosomal protein S25 | 162 | Hs.409158 | NM_001028 | 494 |
| GAPD | Glyceraldehyde-3-phosphate dehydrogenase | 163 | Hs.169476 | NM_002046 | 495 |
| RPLP1 | Ribosomal protein, large, P1 | 164 | Hs.424299 | NM_001003 | 496 |
| OID_5115 | qz23b07.x1 cDNA, 3' end /clone = IMAGE:2027701 | 165 | NA | AI364926 | 497 |
| SLC9A8 | Solute carrier family 9 (sodium/hydrogen exchanger), isoform 8 | 166 | Hs.380978 | AB023156 | 498 |
| OID_1512 | IMAGE:3865861 5 clone 5' | 167 | Hs.381302 | BE618004 | 499 |
| POLR2D | Polymerase (RNA) II (DNA directed) polypeptide D | 168 | Hs.194638 | NM_004805 | 500 |
| ARPC3 | Actin related protein 2/3 complex, subunit 3, 21kDa | 169 | Hs.293750 | NM_005719 | 501 |
| OID_6282 | EST 3' end | 170 | Hs.17132 | BC041913 | 502 |
| PRO1073 | PRO1073 protein | 171 | Hs.356442 | AF001542 | 503 |
| OID_7222 | EST, weakly similar to A43932 mucin 2 precursor, intestinal | 172 | Hs.28310 | BG260891 | 504 |
| FPRL1 | Formyl peptide receptor-like 1 | 173 | Hs.99855 | NM_001462 | 505 |
| FKBPL | FK506 binding protein like | 174 | Hs.99134 | NM_022110 | 506 |
| PREB | Prolactin regulatory element binding | 175 | Hs.279784 | NM_013388 | 507 |
| OID_1551 | Hypothetical protein LOC200227 | 176 | Hs.250824 | BE887646 | 508 |
| OID_7595 | DKFZP566F0546 protein | 177 | Hs.144505 | NM_015653 | 509 |
| RNF19 | Ring finger protein 19 | 178 | Hs.48320 | NM_015435 | 510 |

TABLE 2A-continued

| | | | | | |
|---|---|---|---|---|---|
| SMCY | SMC (mouse) homolog, Y chromosome (SMCY) | 179 | Hs.80358 | NM_004653 | 511 |
| OID_4184 | CMV HCMVUL109 | 180 | NA | X17403 | 512 |
| OID_7504 | Hypothetical protein FLJ35207 | 181 | Hs.86543 | NM_152312 | 513 |
| DNAJC3 | DnaJ (Hsp40) homolog, subfamily C, member 3 | 182 | Hs.9683 | NM_006260 | 514 |
| ARHU | Ras homolog gene family, member U | 183 | Hs.20252 | NM_021205 | 515 |
| OID_7200 | Hypothetical protein FLJ22059 | 184 | Hs.13323 | NM_022752 | 516 |
| SERPINB2 | Serine (or cysteine) proteinase inhibitor, clade B (ovalbumin), member 2 | 185 | Hs.75716 | NM_002575 | 517 |
| ENO1 | Enolase 1, alpha | 186 | Hs.254105 | NM_001428 | 518 |
| OID_7696 | EST 3' end | 187 | Hs.438092 | AW297325 | 519 |
| OID_4173 | CMV HCMVTRL2 (IRL2) | 188 | NA | X17403 | 520 |
| CSF2RB | Upstream variant mRNA of colony stimulating factor 2 receptor, beta, low-affinity (granulocyte-macrophage) | 189 | Hs.285401 | AL540399 | 521 |
| OID_7410 | CM2-LT0042-281299-062-e11 LT0042 cDNA, mRNA sequence | 190 | Hs.375145 | AW837717 | 522 |
| OID_4180 | CMV HCMVUS28 | 191 | NA | X17403 | 523 |
| OID_5101 | EST | 192 | Hs.144814 | BG461987 | 524 |
| MOP3 | MOP-3 | 193 | Hs.380419 | NM_018183 | 525 |
| RPL18A | Ribosomal protein L18a | 194 | Hs.337766 | NM_000980 | 526 |
| INPP5A | Inositol polyphosphate-5-phosphatase, 40kDa | 195 | Hs.124029 | NM_005539 | 527 |
| hIAN7 | Immune associated nucleotide | 196 | Hs.124675 | BG772661 | 528 |
| RPS29 | Ribosomal protein S29 | 197 | Hs.539 | NM_001032 | 529 |
| OID_6008 | EST 3' end | 198 | Hs.352323 | AW592876 | 530 |
| OID_4186 | CMV HCMVUL122 | 199 | NA | X17403 | 531 |
| VNN2 | vanin 2 | 200 | Hs.121102 | NM_004665 | 532 |
| OID_7703 | KIAA0907 protein | 201 | Hs.24656 | NM_014949 | 533 |
| OID_7057 | 480F8 | 202 | NA | 480F8 | 534 |
| OID_4291 | EST | 203 | Hs.355841 | BC038439 | 535 |
| OID_1366 | EST | 204 | Hs.165695 | AW850041 | 536 |
| EEF1A1 | Eukaryotic translation elongation factor 1 alpha 1 | 205 | Hs.422118 | NM_001402 | 537 |
| PA2G4 | Proliferation-associated 2G4, 38kDa | 206 | Hs.374491 | NM_006191 | 538 |
| GAPD | Glyceraldehyde-3-phosphate dehydrogenase | 207 | Hs.169476 | NM_002046 | 539 |
| CHD4 | Chromodomain helicase DNA binding protein 4 | 208 | Hs.74441 | NM_001273 | 540 |
| OID_7951 | E2F-like protein (LOC51270) | 209 | Hs.142908 | NM_016521 | 541 |
| DAB1 | Disabled homolog 1 (Drosophila) | 210 | Hs.344127 | NM_021080 | 542 |
| OID_3406 | Hypothetical protein FLJ20356 | 211 | Hs.61053 | NM_018986 | 543 |
| OID_6986 | 462H9 EST | 212 | Hs.434526 | AK093608 | 544 |
| OID_5962 | EST 3' end | 213 | Hs.372917 | AW452467 | 545 |
| OID_5152 | EST 3' end | 214 | Hs.368921 | AI392805 | 546 |
| S100A8 | S100 calcium-binding protein A8 (calgranulin A) | 215 | Hs.416073 | NM_002964 | 547 |
| HNRPU | HNRPU Heterogeneous nuclear ribonucleoprotein U (scaffold attachment factor A) | 216 | Hs.103804 | BM467823 | 548 |
| ERCC5 | Excision repair cross-complementing rodent repair deficiency, complementation group 5 (xeroderma pigmentosum, complementation group G (Cockayne syndrome)) | 217 | Hs.48576 | NM_000123 | 549 |
| RPS27 | Ribosomal protein S27 (metallopanstimulin 1) | 218 | Hs.195453 | NM_001030 | 550 |
| ACRC | acidic repeat containing (ACRC), | 219 | Hs.135167 | NM_052957 | 551 |
| PSMD11 | Proteasome (prosome, macropain) 26S subunit, non-ATPase, 11 | 220 | Hs.90744 | AI684022 | 552 |
| OID_1016 | FLJ00048 protein | 221 | Hs.289034 | AK024456 | 553 |
| OID_1309 | AV706481 cDNA | 222 | None | AV706481 | 554 |
| OID_7582 | Weakly similar to ZINC FINGER PROTEIN 142 | 223 | Hs.16493 | AK027866 | 555 |
| OID_4317 | ta73c09.x1 3' end /clone = IMAGE:2049712 Ribosomal Protein S15 | 224 | Hs.387179 | AI318342 | 556 |
| OID_5889 | 3' end/clone = IMAGE:3083913 | 225 | Hs.255698 | AW297843 | 557 |
| UBL1 | Ubiquitin-like 1 (sentrin) | 226 | Hs.81424 | NM_003352 | 558 |
| OID_3687 | EST | 227 | None | W03955 | 559 |
| OID_7371 | EST 5' | 228 | Hs.290874 | BE730505 | 560 |
| SH3BGRL3 | SH3 domain binding glutamic acid-rich protein like 3 | 229 | Hs.109051 | NM_031286 | 561 |
| SEMA7A | Sema domain, immunoglobulin domain (Ig), and GPI membrane anchor, (semaphorin) 7A | 230 | Hs.24640 | NM_003612 | 562 |

TABLE 2A-continued

| | | | | | |
|---|---|---|---|---|---|
| OID_5708 | EST 3' end | 231 | Hs.246494 | AW081540 | 563 |
| OID_5992 | EST 3' end | 232 | Hs.257709 | AW467992 | 564 |
| IL21 | Interleukin 21 | 233 | Hs.302014 | NM_021803 | 565 |
| HERC3 | Hect domain and RLD 3 (HERC3) | 234 | Hs.35804 | NM_014606 | 566 |
| OID_7799 | AluJo/FLAM SINE/Alu | 235 | | AW837717 | 567 |
| P11 | 26 serine protease | 236 | Hs.997 | NM_006025 | 568 |
| OID_7766 | EST 3' end | 237 | Hs.437931 | AW294711 | 569 |
| TIMM10 | translocase of inner mitochondrial membrane 10 (yeast) homolog (TIMM10) | 238 | Hs.235750 | NM_012456 | 570 |
| EGLN1 | Egl nine homolog 1 (C. elegans) | 239 | Hs.6523 | AJ310543 | 571 |
| TBCC | Tubulin-specific chaperone c | 240 | Hs.75064 | NM_003192 | 572 |
| RNF3 | Ring finger protein 3 | 241 | Hs.8834 | NM_006315 | 573 |
| OID_6451 | 170F9, hypothetical protein FLJ21439 | 242 | Hs.288872 | AL834168 | 574 |
| CCNDBP1 | cyclin D-type binding-protein 1 (CCNDBP1) | 243 | Hs.36794 | NM_012142 | 575 |
| OID_8063 | MUC18 gene exons 1 & 2 | 244 | NA | X68264 | 576 |
| SUV39H1 | Suppressor of variegation 3-9 homolog 1 (Drosophila) | 245 | Hs.37936 | NM_003173 | 577 |
| HSPC048 | HSPC048 protein | 246 | Hs.278944 | NM_014148 | 578 |
| OID_5625 | EST 3' end from T cells | 247 | Hs.279121 | AW063780 | 579 |
| WARS | Tryptophanyl-tRNA synthetase | 248 | Hs.82030 | NM_004184 | 580 |
| OID_6823 | 107H8 | 249 | Hs.169610 | AL832642 | 581 |
| OID_7073 | 119F12 | 250 | Hs.13264 | AL705961 | 582 |
| OID_5339 | EST 3' end | 251 | Hs.436022 | AI625119 | 583 |
| OID_4263 | fetal retina 937202 cDNA clone IMAGE:565899 | 252 | Hs.70877 | AA136584 | 584 |
| MGC26766 | Hypothetical protein MGC26766 | 253 | Hs.288156 | AK025472 | 585 |
| SERPINB11 | Serine (or cysteine) proteinase inhibitor, clade B (ovalbumin), member 11 | 254 | Hs.350958 | NM_080475 | 586 |
| OID_6711 | 58G4, IMAGE:4359351 5' | 255 | none | BF968628 | 587 |
| RNF10 | Ring finger protein 10 | 256 | Hs.5094 | NM_014868 | 588 |
| MKRN1 | Makorin, ring finger protein, 1 | 257 | Hs.7838 | NM_013446 | 589 |
| RPS16 | ribosomal protein S16 | 258 | Hs.397609 | NM_001020 | 590 |
| BAZ1A | Bromodomain adjacent to zinc finger domain, 1A | 259 | Hs.8858 | NM_013448 | 591 |
| OID_5998 | EST 3' end | 260 | Hs.330268 | AW468459 | 592 |
| ATP5L | ATP synthase, H+ transporting, mitochondrial F0 complex, subunit g | 261 | Hs.107476 | NM_006476 | 593 |
| OID_6393 | 52B9 | 262 | NA | 52B9 | 594 |
| RoXaN | Ubiquitous tetratricopeptide containing protein RoXaN | 263 | Hs.25347 | BC004857 | 595 |
| NCBP2 | Nuclear cap binding protein subunit 2, 20kDa | 264 | Hs.240770 | NM_007362 | 596 |
| OID_6273 | EST 3' end | 265 | Hs.158976 | AW294774 | 597 |
| HZF12 | zinc finger protein 12 | 266 | Hs.164284 | NM_033204 | 598 |
| CCL3 | Chemokine (C-C motif) ligand 3 | 267 | Hs.73817 | D90144 | 599 |
| OID_4323 | IMAGE:1283731 3' | 268 | Hs.370770 | AA744774 | 600 |
| OID_5181 | tg93h12.x1 NCI_CGAP_CLL1 cDNA clone IMAGE:2116391 3' similar to contains TAR1.t1 MER22 | 269 | NA | AI400725 | 601 |
| PRDX4 | Peroxiredoxin 4 | 270 | Hs.83383 | NM_006406 | 602 |
| BTK | Bruton agammaglobulinemia tyrosine kinase | 271 | Hs.159494 | NM_000061 | 603 |
| OID_6298 | Importin beta subunit mRNA | 272 | Hs.180446 | AI948513 | 604 |
| PGK1 | Phosphoglycerate kinase 1 | 273 | Hs.78771 | NM_000291 | 605 |
| TNFRSF10A | Tumor necrosis factor receptor superfamily, member 10a | 274 | Hs.249190 | NM_003844 | 606 |
| ADM | adrenomedullin | 275 | Hs.394 | NM_001124 | 607 |
| OID_357 | 138G5 | 276 | NA | 138G5 | 608 |
| C20orf6 | 461A4 chromosome 20 open reading frame 6 | 277 | Hs.88820 | NM_016649 | 609 |
| OID_3226 | DKFZP564O0823 protein | 278 | Hs.105460 | NM_015393 | 610 |
| ASAH1 | N-acylsphingosine amidohydrolase (acid ceramidase) 1 | 279 | Hs.75811 | NM_004315 | 611 |
| ATF5 | Activating transcription factor 5 | 280 | Hs.9754 | NM_012068 | 612 |
| OID_4887 | hypothetical protein MGC14376 | 281 | Hs.417157 | NM_032895 | 613 |
| OID_4239 | EST | 282 | Hs.177376 | BQ022840 | 614 |
| MDM2 | Mouse double minute 2, homolog of; p53-binding protein (MDM2), transcript variant MDM2. | 283 | Hs.170027 | NM_002392 | 615 |
| XRN2 | 5'-3' exoribonuclease 2 | 284 | Hs.268555 | AF064257 | 616 |
| OID_6039 | Endothelial differentiation, lysophosphatidic acid G-protein-coupled receptor, 4 (EDG4) | 285 | Hs.122575 | BE502246 | 617 |
| OID_4210 | IMAGE:4540096 | 286 | Hs.374836 | AI300700 | 618 |
| OID_7698 | EST 3' end | 287 | Hs.118899 | AA243283 | 619 |

TABLE 2A-continued

| | | | | | |
|---|---|---|---|---|---|
| PRKRA | Protein kinase, interferon-inducible double stranded RNA dependent activator | 288 | Hs.18571 | NM_003690 | 620 |
| OID_4288 | IMAGE:2091815 | 289 | Hs.309108 | AI378046 | 621 |
| OID_5620 | EST 3' end from T cells | 290 | Hs.279116 | AW063678 | 622 |
| OID_7384 | EST 5' | 291 | Hs.445429 | BF475239 | 623 |
| OID_1209 | EST Weakly similar to hypothetical protein FLJ20378 | 292 | Hs.439346 | C14379 | 624 |
| CDKN1B | Cyclin-dependent kinase inhibitor 1B (p27, Kip1) | 293 | Hs.238990 | NM_004064 | 625 |
| PLOD | Procollagen-lysine, 2-oxoglutarate 5-dioxygenase (lysine hydroxylase, Ehlers-Danlos syndrome type VI) | 294 | Hs.75093 | NM_000302 | 626 |
| OID_5128 | EST | 295 | Hs.283438 | AK097845 | 627 |
| OID_5877 | EST 3' end | 296 | Hs.438118 | AW297664 | 628 |
| FZD4 | Frizzled (Drosophila) homolog 4 | 297 | Hs.19545 | NM_012193 | 629 |
| HLA-B | Major histocompatibility complex, class I, B | 298 | Hs.77961 | NM_005514 | 630 |
| OID_5624 | EST 3' end from T cells | 299 | Hs.279120 | AW063921 | 631 |
| FPR1 | Formyl peptide receptor 1 | 300 | Hs.753 | NM_002029 | 632 |
| ODF2 | Outer dense fiber of sperm tails 2 | 301 | Hs.129055 | NM_153437 | 633 |
| OID_5150 | tg04g01.x1 cDNA, 3' end /clone = IMAGE:2107824 | 302 | Hs.160981 | AI392793 | 634 |
| OID_5639 | EST 3' end from T cells | 303 | Hs.279139 | AW064243 | 635 |
| OID_6619 | 469A10 | 304 | NA | 469A10 | 636 |
| OID_6933 | 463C7, 4 EST hits. Aligned | 305 | Hs.86650 | AI089520 | 637 |
| OID_7049 | 480E2 | 306 | NA | 480E2 | 638 |
| IL17C | Interleukin 17C | 307 | Hs.278911 | NM_013278 | 639 |
| OID_5866 | EST 3' end | 308 | Hs.255649 | BM684739 | 640 |
| CD44 | CD44 | 309 | Hs.169610 | AA916990 | 641 |
| VPS45A | Vacuolar protein sorting 45A (yeast) | 310 | Hs.6650 | NM_007259 | 642 |
| OID_4932 | aa92c03.r1 Stratagene fetal retina 937202 cDNA clone IMAGE:838756 | 311 | NA | AA457757 | 643 |
| OID_7821 | EST | 312 | NA | AA743221 | 644 |
| OID_4916 | zr76a03.r1 Soares_NhHMPu_S1 cDNA clone IMAGE:669292 | 313 | NA | AA252909 | 645 |
| OID_4891 | Hypothetical protein LOC255488 | 314 | Hs.294092 | AL832329 | 646 |
| HADHB | Hydroxyacyl-Coenzyme A dehydrogenase/3-ketoacyl-Coenzyme A thiolase/enoyl-Coenzyme A hydratase (trifunctional protein), beta subunit | 315 | Hs.146812 | NM_000183 | 647 |
| FLJ22757 | Hypothetical protein FLJ22757 | 316 | Hs.236449 | NM_024898 | 648 |
| RAC1 | Ras-related C3 botulinum toxin substrate 1 (rho family, small GTP binding protein Rac1) | 317 | Hs.173737 | AK054993 | 649 |
| OID_6415 | 72D4, FLJ00290 protein | 318 | Hs.98531 | CA407201 | 650 |
| NMES1 | Normal mucosa of esophagus specific 1 | 319 | Hs.112242 | NM_032413 | 651 |
| DMBT1 | Deleted in malignant brain tumors 1, transcript variant 2 | 320 | Hs.279611 | NM_007329 | 652 |
| RPS23 | ribosomal protein S23 | 321 | Hs.3463 | NM_001025 | 653 |
| ZF | HCF-binding transcription factor Zhangfei | 322 | Hs.29417 | NM_021212 | 654 |
| NFE2L3 | Nuclear factor (erythroid-derived 2)-like 3 | 323 | Hs.22900 | NM_004289 | 655 |
| RAD9 | RAD9 homolog (S. pombe) | 324 | Hs.240457 | NM_004584 | 656 |
| OID_6295 | EST 3' end | 325 | Hs.389327 | AI880607 | 657 |
| DEFCAP | Death effector filament-forming Ced-4-like apoptosis protein, transcript variant B | 326 | Hs.104305 | NM_014922 | 658 |
| RPL27A | Ribosomal protein L27a | 327 | Hs.76064 | BF214146 | 659 |
| IL22 | Interleukin 22 (IL22) | 328 | Hs.287369 | NM_020525 | 660 |
| PSMA4 | Proteasome (prosome, macropain) subunit, alpha type, 4, (PSMA4) | 329 | Hs.251531 | NM_002789 | 661 |
| CCNI | cyclin I (CCNI) | 330 | Hs.79933 | NM_006835 | 662 |
| THBD | Thrombomodulin | 331 | Hs.2030 | NM_000361 | 663 |
| CGR19 | Cell growth regulatory with ring finger domain | 332 | Hs.59106 | NM_006568 | 664 |

| SEQ ID 50mer | Gene | Gene Name | ACC | SEQ ID RNA/cDNA | Non-Para Score | Median Rank in NR | Down Regulated |
|---|---|---|---|---|---|---|---|
| 152 | CLC | Charot-Leyden crystal protein | NM_001828 | 484 | 779 | 4342 | |
| 153 | TERF2IP | telomeric repeat binding factor 2, interacting protein | NM_018975 | 485 | 744 | 1775 | |
| 154 | HLA-A | Major histocompatibility complex, class I, A | NM_002116 | 486 | 735 | 125 | 1 |

TABLE 2A-continued

| | | | | | | | |
|---|---|---|---|---|---|---|---|
| 155 | OID_5891 | EST 3' end | AW297949 | 487 | 730 | 7044.5 | 1 |
| 156 | MSCP | mitochondrial solute carrier protein | NM_018579 | 488 | 730 | 3465.5 | |
| 157 | DUSP5 | dual specificity phosphatase 5 | NM_004419 | 489 | 726 | 3122.5 | |
| 158 | PRO1853 | Hypothetical protein PRO1853 | NM_018607 | 490 | 725 | 4153 | |
| 159 | OID_6420 | 73A7, FLJ00290 protein | AK090404 | 491 | 725 | 7000.5 | |
| 160 | CDSN | Corneodesmosin | NM_001264 | 492 | 722 | 2732 | |
| 161 | OID_4269 | EST | BM727677 | 493 | 715 | 5598.5 | |
| 162 | RPS25 | Ribosomal protein S25 | NM_001028 | 494 | 710 | 164.5 | |
| 163 | GAPD | Glyceraldehyde-3-phosphate dehydrogenase | NM_002046 | 495 | 707 | 215.5 | |
| 164 | RPLP1 | Ribosomal protein, large, P1 | NM_001003 | 496 | 703 | 157 | |
| 165 | OID_5115 | qz23b07.x1 cDNA, 3' end /clone = IMAGE:2027701 | AI364926 | 497 | 703 | 6629 | 1 |
| 166 | SLC9A8 | Solute carrier family 9 (sodium/hydrogen exchanger), isoform 8 | AB023156 | 498 | 702 | 2538.5 | |
| 167 | OID_1512 | IMAGE:3865861 5 clone 5' | BE618004 | 499 | 700 | 4008 | 1 |
| 168 | POLR2D | Polymerase (RNA) II (DNA directed) polypeptide D | NM_004805 | 500 | 700 | 4190.5 | |
| 169 | ARPC3 | Actin related protein 2/3 complex, subunit 3, 21kDa | NM_005719 | 501 | 698 | 470.5 | |
| 170 | OID_6282 | EST 3' end | BC041913 | 502 | 697 | 4371.5 | |
| 171 | PRO1073 | PRO1073 protein | AF001542 | 503 | 697 | 6754 | |
| 172 | OID_7222 | EST, weakly similar to A43932 mucin 2 precursor, intestinal | BG260891 | 504 | 695 | 6759 | |
| 173 | FPRL1 | Formyl peptide receptor-like 1 | NM_001462 | 505 | 692 | 4084.5 | |
| 174 | FKBPL | FK506 binding protein like | NM_022110 | 506 | 691 | 1780.5 | |
| 175 | PREB | Prolactin regulatory element binding | NM_013388 | 507 | 690 | 3568 | |
| 176 | OID_1551 | Hypothetical protein LOC200227 | BE887646 | 508 | 689 | 6423 | 1 |
| 177 | OID_7595 | DKFZP566F0546 protein | NM_015653 | 509 | 689 | 3882.5 | |
| 178 | RNF19 | Ring finger protein 19 | NM_015435 | 510 | 689 | 7700.5 | |
| 179 | SMCY | SMC (mouse) homolog, Y chromosome (SMCY) | NM_004653 | 511 | 687 | 6074.5 | |
| 180 | OID_4184 | CMV HCMVUL109 | X17403 | 512 | 687 | 6810.5 | |
| 181 | OID_7504 | Hypothetical protein FLJ35207 | NM_152312 | 513 | 686 | 6939 | |
| 182 | DNAJC3 | DnaJ (Hsp40) homolog, subfamily C, member 3 | NM_006260 | 514 | 686 | 3932.5 | |
| 183 | ARHU | Ras homolog gene family, member U | NM_021205 | 515 | 686 | 7584 | |
| 184 | OID_7200 | Hypothetical protein FLJ22059 | NM_022752 | 516 | 685 | 2804.5 | |
| 185 | SERPINB2 | Serine (or cysteine) protenase inhibitor, clade B (ovalbumin), member 2 | NM_002575 | 517 | 684 | 4690.5 | |
| 186 | ENO1 | Enolase 1, alpha | NM_001428 | 518 | 684 | 327 | |
| 187 | OID_7696 | EST 3' end | AW297325 | 519 | 683 | 4875.5 | |
| 188 | OID_4173 | CMV HCMVTRL2 (IRL2) | X17403 | 520 | 683 | 4010.5 | |
| 189 | CSF2RB | Upstream variant mRNA of colony stimulating factor 2 receptor, beta, low-affinity (granulocyte-macrophage) | AL540399 | 521 | 683 | 3753 | |
| 190 | OID_7410 | CM2-LT0042-281299-062-e11 LT0042 cDNA, mRNA sequence | AW837717 | 522 | 682 | 7445 | |
| 191 | OID_4180 | CMV HCMVUS28 | X17403 | 523 | 681 | 4359 | |
| 192 | OID_5101 | EST | BG461987 | 524 | 681 | 7272 | |
| 193 | MOP3 | MOP-3 | NM_018183 | 525 | 681 | 4085.5 | 1 |
| 194 | RPL18A | Ribosomal protein L18a | NM_000980 | 526 | 680 | 238 | |
| 195 | INPP5A | Inositol polyphosphate-5-phosphatase, 40kDa | NM_005539 | 527 | 680 | 4838.5 | 1 |
| 196 | hIAN7 | Immune associated nucleotide | BG772661 | 528 | 680 | 4718 | |
| 197 | RPS29 | Ribosomal protein S29 | NM_001032 | 529 | 680 | 107.5 | |
| 198 | OID_6008 | EST 3' end | AW592876 | 530 | 679 | 6560.5 | |
| 199 | OID_4186 | CMV HCMVUL122 | X17403 | 531 | 677 | 4788.5 | |
| 200 | VNN2 | vanin 2 | NM_004665 | 532 | 677 | 2620.5 | |
| 201 | OID_7703 | KIAA0907 protein | NM_014949 | 533 | 676 | 6104.5 | |
| 202 | OID_7057 | 480F8 | 480F8 | 534 | 675 | 6862 | |
| 203 | OID_4291 | EST | BC038439 | 535 | 674 | 5618.5 | |
| 204 | OID_1366 | EST | AW850041 | 536 | 674 | 5590.5 | 1 |
| 205 | EEF1A1 | Eukaryotic translation elongation factor 1 alpha 1 | NM_001402 | 537 | 672 | 232 | |
| 206 | PA2G4 | Proliferation-associated 2G4, 38kDa | NM_006191 | 538 | 672 | 4402 | |
| 207 | GAPD | Glyceraldehyde-3-phosphate dehydrogenase | NM_002046 | 539 | 671 | 194.5 | |
| 208 | CHD4 | Chromodomain helicase DNA binding protein 4 | NM_001273 | 540 | 671 | 2578.5 | |
| 209 | OID_7951 | E2F-like protein (LOC51270) | NM_016521 | 541 | 671 | 4467 | |
| 210 | DAB1 | Disabled homolog 1 (*Drosophila*) | NM_021080 | 542 | 670 | 6357.5 | |
| 211 | OID_3406 | Hypothetical protein FLJ20356 | NM_018986 | 543 | 669 | 2087 | |
| 212 | OID_6986 | 462H9 EST | AK093608 | 544 | 669 | 4454 | 1 |
| 213 | OID_5962 | EST 3' end | AW452467 | 545 | 668 | 5870.5 | 1 |
| 214 | OID_5152 | EST 3' end | AI392805 | 546 | 668 | 6354.5 | |

TABLE 2A-continued

| | | | | | | | |
|---|---|---|---|---|---|---|---|
| 215 | S100A8 | S100 calcium-binding protein A8 calgranulin A) | NM_002964 | 547 | 668 | 134 | |
| 216 | HNRPU | HNRPU Heterogeneous nuclear ribonucleoprotein U (scaffold attachment factor A) | BM467823 | 548 | 668 | 4108 | |
| 217 | ERCC5 | Excision repair cross-complementing rodent repair deficiency, complementation group 5 (xeroderma pigmentosum, complementation group G (Cockayne syndrome)) | NM_000123 | 549 | 668 | 6430.5 | |
| 218 | RPS27 | Ribosomal protein S27 (metallopanstimulin 1) | NM_001030 | 550 | 668 | 160 | |
| 219 | ACRC | acidic repeat containing (ACRC), | NM_052957 | 551 | 668 | 4871.5 | 1 |
| 220 | PSMD11 | Proteasome (prosome, macropain) 26S subunit, non-ATPase, 11 | AI684022 | 552 | 668 | 4138 | |
| 221 | OID_1016 | FLJ00048 protein | AK024456 | 553 | 667 | 5199 | |
| 222 | OID_1309 | AV706481 cDNA | AV706481 | 554 | 667 | 7279.5 | |
| 223 | OID_7582 | Weakly similar to ZINC FINGER PROTEIN 142 | AK027866 | 555 | 667 | 5003.5 | 1 |
| 224 | OID_4317 | ta73c09.x1 3' end /clone = IMAGE:2049712 Ribosomal Protein S15 | AI318342 | 556 | 667 | 6499 | |
| 225 | OID_5889 | 3' end/clone = IMAGE:3083913 | AW297843 | 557 | 666 | 6837 | 1 |
| 226 | UBL1 | Ubiquitin-like 1 (sentrin) | NM_003352 | 558 | 666 | 1978.5 | |
| 227 | OID_3687 | EST | W03955 | 559 | 666 | 5519.5 | |
| 228 | OID_7371 | EST 5' | BE730505 | 560 | 665 | 7751.5 | |
| 229 | SH3BGRL3 | SH3 domain binding glutamic acid-rich protein like 3 | NM_031286 | 561 | 665 | 310 | |
| 230 | SEMA7A | Sema domain, immunoglobulin domain (Ig), and GPI membrane anchor, (semaphorin) 7A | NM_003612 | 562 | 665 | 3505.5 | |
| 231 | OID_5708 | EST 3' end | AW081540 | 563 | 665 | 6224.5 | |
| 232 | OID_5992 | EST 3' end | AW467992 | 564 | 665 | 5648 | |
| 233 | IL21 | Interleukin 21 | NM_021803 | 565 | 664 | 5036.5 | |
| 234 | HERC3 | Hect domain and RLD 3 (HERC3) | NM_014606 | 566 | 664 | 3056.5 | 1 |
| 235 | OID_7799 | AluJo/FLAM SINE/Alu | AW837717 | 567 | 664 | 3544 | |
| 236 | P11 | 26 serine protease | NM_006025 | 568 | 664 | 7173 | |
| 237 | OID_7766 | EST 3' end | AW294711 | 569 | 663 | 7270.5 | |
| 238 | TIMM10 | translocase of inner mitochondrial membrane 10 (yeast) homolog (TIMM10) | NM_012456 | 570 | 663 | 4779.5 | |
| 239 | EGLN1 | Egl nine homolog 1 (C. elegans) | AJ310543 | 571 | 662 | 7172.5 | |
| 240 | TBCC | Tubulin-specific chaperone c | NM_003192 | 572 | 662 | 3384 | |
| 241 | RNF3 | Ring finger protein 3 | NM_006315 | 573 | 661 | 4062 | |
| 242 | OID_6451 | 170F9, hypothetical protein FLJ21439 | AL834168 | 574 | 661 | 7126 | 1 |
| 243 | CCNDBP1 | cyclin D-type binding-protein 1 (CCNDBP1) | NM_012142 | 575 | 661 | 1919 | |
| 244 | OID_8063 | MUC18 gene exons 1 & 2 | X68264 | 576 | 661 | 4692.5 | |
| 245 | SUV39H1 | Suppressor of variegation 3-9 homolog 1 (Drosophila) | NM_003173 | 577 | 661 | 5103 | 1 |
| 246 | HSPC048 | HSPC048 protein | NM_014148 | 578 | 660 | 5981.5 | |
| 247 | OID_5625 | EST 3' end from T cells | AW063780 | 579 | 660 | 4437 | 1 |
| 248 | WARS | Tryptophanyl-tRNA synthetase | NM_004184 | 580 | 660 | 905.5 | |
| 249 | OID_6823 | 107H8 | AL832642 | 581 | 659 | 2619 | |
| 250 | OID_7073 | 119F12 | AL705961 | 582 | 659 | 6837.5 | |
| 251 | OID_5339 | EST 3' end | AI625119 | 583 | 658 | 4414.5 | 1 |
| 252 | OID_4263 | fetal retina 937202 cDNA clone IMAGE:565899 | AA136584 | 584 | 658 | 5870 | |
| 253 | MGC26766 | Hypothetical protein MGC26766 | AK025472 | 585 | 658 | 1892.5 | |
| 254 | SERPINB11 | Serine (or cysteine) proteinase inhibitor, clade B (ovalbumin), member 11 | NM_080475 | 586 | 658 | 7535.5 | 1 |
| 255 | OID_6711 | 58G4, IMAGE:4359351 5' | BF968628 | 587 | 658 | 7264 | |
| 256 | RNF10 | Ring finger protein 10 | NM_014868 | 588 | 658 | 3127.5 | |
| 257 | MKRN1 | Makorin, ring finger protein, 1 | NM_013446 | 589 | 658 | 2228.5 | |
| 258 | RPS16 | ribosomal protein S16 | NM_001020 | 590 | 657 | 165.5 | |
| 259 | BAZ1A | Bromodomain adjacent to zinc finger domain, 1A | NM_013448 | 591 | 657 | 2533 | |
| 260 | OID_5998 | EST 3' end | AW468459 | 592 | 657 | 6339.5 | |
| 261 | ATP5L | ATP synthase, H+ transporting, mitochondrial F0 complex, subunit g | NM_006476 | 593 | 657 | 1155 | |
| 262 | OID_6393 | 52B9 | 52B9 | 594 | 657 | 7420.5 | |
| 263 | RoXaN | Ubiquitous tetratricopeptide containing protein RoXaN | BC004857 | 595 | 656 | 7378 | |
| 264 | NCBP2 | Nuclear cap binding protein subunit 2, 20kDa | NM_007362 | 596 | 656 | 4666.5 | |
| 265 | OID_6273 | EST 3' end | AW294774 | 597 | 656 | 5498.5 | |
| 266 | HZF12 | zinc finger protein 12 | NM_033204 | 598 | 656 | 4715.5 | |

TABLE 2A-continued

| | | | | | | | |
|---|---|---|---|---|---|---|---|
| 267 | CCL3 | Chemokine (C-C motif) ligand 3 | D90144 | 599 | 656 | 4910 | 1 |
| 268 | OID_4323 | IMAGE:1283731 3' | AA744774 | 600 | 655 | 6406.5 | 1 |
| 269 | OID_5181 | tg93h12.x1 NCI_CGAP_CLL1 cDNA clone IMAGE:2116391 3' similar to contains TAR1.t1 MER22 | AI400725 | 601 | 655 | 4838 | 1 |
| 270 | PRDX4 | Peroxiredoxin 4 | NM_006406 | 602 | 655 | 3397.5 | |
| 271 | BTK | Bruton agammaglobulinemia tyrosine kinase | NM_000061 | 603 | 655 | 2358 | |
| 272 | OID_6298 | Importin beta subunit mRNA | AI948513 | 604 | 655 | 2433.5 | |
| 273 | PGK1 | Phosphoglycerate kinase 1 | NM_000291 | 605 | 655 | 2059.5 | |
| 274 | TNFRSF10A | Tumor necrosis factor receptor superfamily, member 10a | NM_003844 | 606 | 654 | 4897.5 | |
| 275 | ADM | adrenomedullin | NM_001124 | 607 | 654 | 4235 | |
| 276 | OID_357 | 138G5 | 138G5 | 608 | 654 | 5427.5 | 1 |
| 277 | C20orf6 | 461A4 chromosome 20 open reading frame 6 | NM_016649 | 609 | 654 | 6343 | 1 |
| 278 | OID_3226 | DKFZP564O0823 protein | NM_015393 | 610 | 653 | 6187.5 | |
| 279 | ASAH1 | N-acylsphingosine amidohydrolase (acid ceramidase) 1 | NM_004315 | 611 | 653 | 1003 | |
| 280 | ATF5 | Activating transcription factor 5 | NM_012068 | 612 | 653 | 4545.5 | |
| 281 | OID_4887 | hypothetical protein MGC14376 | NM_032895 | 613 | 653 | 2310 | 1 |
| 282 | OID_4239 | EST | BQ022840 | 614 | 652 | 2774.5 | |
| 283 | MDM2 | Mouse double minute 2, homolog of; p53-binding protein (MDM2), transcript variant MDM2, | NM_002392 | 615 | 652 | 4342 | |
| 284 | XRN2 | 5'-3' exoribonuclease 2 | AF064257 | 616 | 652 | 6896.5 | |
| 285 | OID_6039 | Endothelial differentiation, lysophosphatidic acid G-protein-coupled receptor, 4 (EDG4) | BE502246 | 617 | 652 | 5147 | |
| 286 | OID_4210 | IMAGE:4540096 | AI300700 | 618 | 652 | 1330.5 | |
| 287 | OID_7698 | EST 3' end | AA243283 | 619 | 652 | 7432.5 | 1 |
| 288 | PRKRA | Protein kinase, interferon-inducible double stranded RNA dependent activator | NM_003690 | 620 | 652 | 3512.5 | |
| 289 | OID_4288 | IMAGE:2091815 | AI378046 | 621 | 651 | 6401.5 | |
| 290 | OID_5620 | EST 3' end from T cells | AW063678 | 622 | 651 | 6400 | |
| 291 | OID_7384 | EST 5' | BF475239 | 623 | 651 | 6875 | |
| 292 | OID_1209 | EST Weakly similar to hypothetical protein FLJ20378 | C14379 | 624 | 651 | 1356.5 | 1 |
| 293 | CDKN1B | Cyclin-dependent kinase inhibitor 1B (p27, Kip1) | NM_004064 | 625 | 650 | 4272.5 | |
| 294 | PLOD | Procollagen-lysine, 2-oxoglutarate 5-dioxygenase (lysine hydroxylase, Ehlers-Danlos syndrome type VI) | NM_000302 | 626 | 650 | 3101 | |
| 295 | OID_5128 | EST | AK097845 | 627 | 650 | 6476 | |
| 296 | OID_5877 | EST 3' end | AW297664 | 628 | 650 | 6864.5 | 1 |
| 297 | FZD4 | Frizzled (Drosophila) homolog 4 | NM_012193 | 629 | 650 | 5816 | |
| 298 | HLA-B | Major histocompatibility complex, class I, B | NM_005514 | 630 | 650 | 229 | |
| 299 | OID_5624 | EST 3' end from T cells | AW063921 | 631 | 649 | 7812.5 | |
| 300 | FPR1 | Formyl peptide receptor 1 | NM_002029 | 632 | 649 | 1156.5 | |
| 301 | ODF2 | Outer dense fiber of sperm tails 2 | NM_153437 | 633 | 649 | 4982.5 | |
| 302 | OID_5150 | tg04g01.x1 cDNA, 3' end /clone = IMAGE:2107824 | AI392793 | 634 | 649 | 7638 | |
| 303 | OID_5639 | EST 3' end from T cells | AW064243 | 635 | 648 | 6805 | 1 |
| 304 | OID_6619 | 469A10 | 469A10 | 636 | 647 | 7110 | 1 |
| 305 | OID_6933 | 463C7, 4 EST hits. Aligned | AI089520 | 637 | 647 | 6880.5 | 1 |
| 306 | OID_7049 | 480E2 | 480E2 | 638 | 647 | 7128.5 | |
| 307 | IL17C | Interleukin 17C | NM_013278 | 639 | 647 | 6411.5 | |
| 308 | OID_5866 | EST 3' end | BM684739 | 640 | 647 | 6532 | 1 |
| 309 | CD44 | CD44 | AA916990 | 641 | 646 | 4758 | |
| 310 | VPS45A | Vacuolar protein sorting 45A (yeast) | NM_007259 | 642 | 646 | 3371 | |
| 311 | OID_4932 | aa92c03.r1 Stratagene fetal retina 937202 cDNA clone IMAGE:838756 | AA457757 | 643 | 646 | 6057 | 1 |
| 312 | OID_7821 | EST | AA743221 | 644 | 645 | 7507 | |
| 313 | OID_4916 | zr76a03.r1 Soares_NhHMPu_S1 cDNA clone IMAGE:669292 | AA252909 | 645 | 645 | 6962.5 | 1 |
| 314 | OID_4891 | Hypothetical protein LOC255488 | AL832329 | 646 | 645 | 6148.5 | |
| 315 | HADHB | Hydroxyacyl-Coenzyme A dehydrogenase/3-ketoacyl-Coenzyme A thiolase/enoyl-Coenzyme A hydratase (trifunctional protein), beta subunit | NM_000183 | 647 | 645 | 3212.5 | |
| 316 | FLJ22757 | Hypothetical protein FLJ22757 | NM_024898 | 648 | 644 | 1965.5 | 1 |
| 317 | RAC1 | Ras-related C3 botulinum toxin substrate 1 (rho family, small GTP binding protein Rac1) | AK054993 | 649 | 644 | 1533 | |
| 318 | OID_6415 | 72D4, FLJ00290 protein | CA407201 | 650 | 644 | 4881 | |
| 319 | NMES1 | Normal mucosa of esophagus specific 1 | NM_032413 | 651 | 644 | 6217 | |

TABLE 2A-continued

| | | | | | | | |
|---|---|---|---|---|---|---|---|
| 320 | DMBT1 | Deleted in malignant brain tumors 1, transcript variant 2 | NM_007329 | 652 | 644 | 7284 | |
| 321 | RPS23 | ribosomal protein S23 | NM_001025 | 653 | 643 | 219.5 | |
| 322 | ZF | HCF-binding transcription factor Zhangfei | NM_021212 | 654 | 643 | 4069 | |
| 323 | NFE2L3 | Nuclear factor (erythroid-derived 2)-like 3 | NM_004289 | 655 | 643 | 3378 | |
| 324 | RAD9 | RAD9 homolog (S. pombe) | NM_004584 | 656 | 643 | 6453 | |
| 325 | OID_6295 | EST 3' end | AI880607 | 657 | 643 | 7493.5 | |
| 326 | DEFCAP | Death effector filament-forming Ced-4-like apoptosis protein, transcript variant B | NM_014922 | 658 | 643 | 3059 | |
| 327 | RPL27A | Ribosomal protein L27a | BF214146 | 659 | 642 | 6571 | 1 |
| 328 | IL22 | Interleukin 22 (IL22) | NM_020525 | 660 | 642 | 3891 | 1 |
| 329 | PSMA4 | Proteasome (prosome, macropain) subunit, alpha type, 4, (PSMA4) | NM_002789 | 661 | 641 | 1934.5 | |
| 330 | CCNI | cyclin I (CCNI) | NM_006835 | 662 | 641 | 980.5 | |
| 331 | THBD | Thrombomodulin | NM_000361 | 663 | 640 | 4732.5 | |
| 332 | CGR19 | Cell growth regulatory with ring finger domain | NM_006568 | 664 | 640 | 5510 | |

| Gene | SEQ ID 50mer | SEQ ID RNA/cDNA | PCR Forward Primer 1 SEQ ID | PCR Reverse Primer 1 SEQ ID | PCR Probe 1 SEQ ID | PCR Forward Primer 2 SEQ ID | PCR Reverse Primer 2 SEQ ID | PCR Probe 2 SEQ ID |
|---|---|---|---|---|---|---|---|---|
| HSRRN18S | 1 | 333 | 665 | 996 | 1327 | | | |
| ACTB | 2 | 334 | 666 | 997 | 1328 | | | |
| GUSB | 3 | 335 | 667 | 998 | 1329 | 1656 | 1904 | 2152 |
| B2M | 4 | 336 | 668 | 999 | 1330 | | | |
| TSN | 5 | 337 | 669 | 1000 | 1331 | 1657 | 1905 | 2153 |
| CCR7 | 6 | 338 | 670 | 1001 | 1332 | | | |
| IL1R2 | 7 | 339 | 671 | 1002 | 1333 | 1658 | 1906 | 2154 |
| AIF-1 | 8 | 340 | 672 | 1003 | 1334 | | | |
| ALAS2 | 9 | 341 | 673 | 1004 | 1335 | | | |
| APELIN | 10 | 342 | 674 | 1005 | 1336 | | | |
| CD80 | 11 | 343 | 675 | 1006 | 1337 | 1659 | 1907 | 2145 |
| EPB41 | 12 | 344 | 676 | 1007 | 1338 | | | |
| CBLB | 13 | 345 | 677 | 1008 | 1339 | 1660 | 1908 | 2156 |
| CCR5 | 14 | 346 | 678 | 1009 | 1340 | 1661 | 1909 | 2157 |
| MME | 15 | 347 | 679 | 1010 | 1341 | 1662 | 1910 | 2158 |
| KLRC1 | 16 | 348 | 680 | 1011 | 1342 | 1663 | 1911 | 2159 |
| FCGR3A | 17 | 349 | 681 | 1012 | 1343 | | | |
| FCGR3B | 18 | 350 | 682 | 1013 | 1344 | 1664 | 1912 | 2160 |
| LAG3 | 19 | 351 | 683 | 1014 | 1345 | 1665 | 1913 | 2161 |
| PECAM1 | 20 | 352 | 684 | 1015 | 1346 | 1666 | 1914 | 2162 |
| CD34 | 21 | 353 | 685 | 1016 | 1347 | 1667 | 1915 | 2163 |
| FCGR1A | 22 | 354 | 686 | 1017 | 1348 | 1668 | 1916 | 2164 |
| TFRC | 23 | 355 | 687 | 1018 | 1349 | | | |
| CMA1 | 24 | 356 | 688 | 1019 | 1350 | 1669 | 1917 | 2165 |
| KIT | 25 | 357 | 689 | 1020 | 1351 | | | |
| MPL | 26 | 358 | 690 | 1021 | 1352 | 1670 | 1918 | 2166 |
| EphB6 | 27 | 359 | 691 | 1022 | 1353 | | | |
| EPOR | 28 | 360 | 692 | 1023 | 1354 | | | |
| Foxp3 | 29 | 361 | 693 | 1024 | 1355 | 1671 | 1919 | 2167 |
| GATA-1 | 30 | 362 | 694 | 1025 | 1356 | | | |
| ITGA2B | 31 | 363 | 695 | 1026 | 1357 | 1672 | 1920 | 2168 |
| GNLY | 32 | 364 | 696 | 1027 | 1358 | 1673 | 1921 | 2169 |
| GZMA | 33 | 365 | 697 | 1028 | 1359 | 1674 | 1922 | 2170 |
| HBA | 34 | 366 | 698 | 1029 | 1360 | 1675 | 1923 | 2171 |
| HBZ | 35 | 367 | 699 | 1030 | 1361 | 1676 | 1924 | 2172 |
| HBB | 36 | 368 | 700 | 1031 | 1362 | 1677 | 1925 | 2173 |
| HBD | 37 | 369 | 701 | 1032 | 1363 | 1678 | 1926 | 2174 |
| HBE | 38 | 370 | 702 | 1033 | 1364 | 1679 | 1927 | 2175 |
| HBG | 39 | 371 | 703 | 1034 | 1365 | 1680 | 1928 | 2176 |
| HBQ | 40 | 372 | 704 | 1035 | 1366 | 1681 | 1929 | 2177 |
| HLA-DP | 41 | 373 | 705 | 1036 | 1367 | 1682 | 1930 | 2178 |
| HLA-DQ | 42 | 374 | 706 | 1037 | 1368 | 1683 | 1931 | 2179 |
| HLA-DRB | 43 | 375 | 707 | 1038 | 1369 | 1684 | 1932 | 2180 |
| ICOS | 44 | 376 | 708 | 1039 | 1370 | 1685 | 1933 | 2181 |
| IL18 | 45 | 377 | 709 | 1040 | 1371 | 1686 | 1934 | 2182 |
| IL3 | 46 | 378 | 710 | 1041 | 1372 | 1687 | 1935 | 2183 |
| ITGA4 | 47 | 379 | 711 | 1042 | 1373 | | | |
| ITGAM | 48 | 380 | 712 | 1043 | 1374 | 1688 | 1936 | 2184 |
| ITGB7 | 49 | 381 | 713 | 1044 | 1375 | | | |
| CEBPB | 50 | 382 | 714 | 1045 | 1376 | 1689 | 1937 | 2185 |
| NF-E2 | 51 | 383 | 715 | 1046 | 1377 | | | |
| PDCD1 | 52 | 384 | 716 | 1047 | 1378 | 1690 | 1938 | 2186 |
| PF4 | 53 | 385 | 717 | 1048 | 1379 | 1691 | 1939 | 2187 |

TABLE 2A-continued

| | | | | | | | | |
|---|---|---|---|---|---|---|---|---|
| PRKCQ | 54 | 386 | 718 | 1049 | 1380 | 1692 | 1940 | 2188 |
| PPARGC1 | 55 | 387 | 719 | 1050 | 1381 | | | |
| RAG1 | 56 | 388 | 720 | 1051 | 1382 | 1693 | 1941 | 2189 |
| RAG2 | 57 | 389 | 721 | 1052 | 1383 | 1694 | 1942 | 2190 |
| CXCL12 | 58 | 390 | 722 | 1053 | 1384 | 1695 | 1943 | 2191 |
| TNFRSF4 | 59 | 391 | 723 | 1054 | 1385 | 1696 | 1944 | 2192 |
| TNFSF4 | 60 | 392 | 724 | 1055 | 1386 | 1697 | 1945 | 2193 |
| TPS1 | 61 | 393 | 725 | 1056 | 1387 | 1698 | 1946 | 2194 |
| ADA | 62 | 394 | 726 | 1057 | 1388 | 1699 | 1947 | 2195 |
| CPM | 63 | 395 | 727 | 1058 | 1389 | 1700 | 1948 | 2196 |
| CSF2 | 64 | 396 | 728 | 1059 | 1390 | 1701 | 1949 | 2197 |
| CSF3 | 65 | 397 | 729 | 1060 | 1391 | 1702 | 1950 | 2198 |
| CRP | 66 | 398 | 730 | 1061 | 1392 | 1703 | 1951 | 2199 |
| FLT3 | 67 | 399 | 731 | 1062 | 1393 | 1704 | 1952 | 2200 |
| GATA3 | 68 | 400 | 732 | 1063 | 1394 | 1705 | 1953 | 2201 |
| IL7R | 69 | 401 | 733 | 1064 | 1395 | 1706 | 1954 | 2202 |
| KLF1 | 70 | 402 | 734 | 1065 | 1396 | 1707 | 1955 | 2203 |
| LCK | 71 | 403 | 735 | 1066 | 1397 | 1708 | 1956 | 2204 |
| LEF1 | 72 | 404 | 736 | 1067 | 1398 | 1709 | 1957 | 2205 |
| PLAUR | 73 | 405 | 737 | 1068 | 1399 | 1710 | 1958 | 2206 |
| TNFSF13B | 74 | 406 | 738 | 1069 | 1400 | 1711 | 1959 | 2207 |
| IL8 | 75 | 407 | 739 | 1070 | 1401 | | | |
| GZMB | 76 | 408 | 740 | 1071 | 1402 | | | |
| TNFSF6 | 77 | 409 | 741 | 1072 | 1403 | | | |
| TCIRG1 | 78 | 410 | 742 | 1073 | 1404 | | | |
| PRF1 | 79 | 411 | 743 | 1074 | 1405 | | | |
| IL4 | 80 | 412 | 744 | 1075 | 1406 | | | |
| IL13 | 81 | 413 | 745 | 1076 | 1407 | | | |
| CTLA4 | 82 | 414 | 746 | 1077 | 1408 | | | |
| CD8A | 83 | 415 | 747 | 1078 | 1409 | | | |
| BY55 | 84 | 416 | 748 | 1079 | 1410 | | | |
| OID_4460 | 85 | 417 | 749 | 1080 | 1411 | | | |
| HBB | 86 | 418 | 750 | 1081 | 1412 | | | |
| BPGM | 87 | 419 | 751 | 1082 | 1413 | | | |
| MTHFD2 | 88 | 420 | 752 | 1083 | 1414 | | | |
| TAP1 | 89 | 421 | 753 | 1084 | 1415 | | | |
| KPNA6 | 90 | 422 | 754 | 1085 | 1416 | | | |
| OID_4365 | 91 | 423 | 755 | 1086 | 1417 | | | |
| IGHM | 92 | 424 | 756 | 1087 | 1418 | | | |
| OID_573 | 93 | 425 | 757 | 1088 | 1419 | 1712 | 1960 | 2208 |
| OID_873 | 94 | 426 | 758 | 1089 | 1420 | | | |
| OID_3 | 95 | 427 | 759 | 1090 | 1421 | | | |
| CXCR4 | 96 | 428 | 760 | 1091 | 1422 | | | |
| CD69 | 97 | 429 | 761 | 1092 | 1423 | | | |
| CCL5 | 98 | 430 | 762 | 1093 | 1424 | | | |
| IL6 | 99 | 431 | 763 | 1094 | 1425 | | | |
| IL2 | 100 | 432 | 764 | 1095 | 1426 | | | |
| KLRF1 | 101 | 433 | 765 | 1096 | 1427 | | | |
| LYN | 102 | 434 | 766 | 1097 | 1428 | | | |
| IL2RA | 103 | 435 | 767 | 1098 | 1429 | | | |
| CCL4 | 104 | 436 | 768 | 1099 | 1430 | | | |
| OID_6207 | 105 | 437 | 769 | 1100 | 1431 | | | |
| ChGn | 106 | 438 | 770 | 1101 | 1432 | | | |
| OID_4281 | 107 | 439 | 771 | 1102 | 1433 | | | |
| CXCL9 | 108 | 440 | 772 | 1103 | 1434 | | | |
| CXCL10 | 109 | 441 | 773 | 1104 | 1435 | | | |
| IL17 | 110 | 442 | 774 | 1105 | 1436 | | | |
| IL15 | 111 | 443 | 775 | 1106 | 1437 | | | |
| IL10 | 112 | 444 | 776 | 1107 | 1438 | | | |
| IFNG | 113 | 445 | 777 | 1108 | 1439 | 1713 | 1961 | 2209 |
| HLA-DRB1 | 114 | 446 | 778 | 1109 | 1440 | 1714 | 1962 | 2210 |
| CD8B1 | 115 | 447 | 779 | 1110 | 1441 | | | |
| CD4 | 116 | 448 | 780 | 1111 | 1442 | | | |
| CXCR3 | 117 | 449 | 781 | 1112 | 1443 | | | |
| OID_7094 | 118 | 450 | 782 | 1113 | 1444 | | | |
| OID_7605 | 119 | 451 | 783 | 1114 | 1445 | | | |
| CXCL1 | 120 | 452 | 784 | 1115 | 1446 | | | |
| OID_253 | 121 | 453 | 785 | 1116 | 1447 | | | |
| GPI | 122 | 454 | 786 | 1117 | 1448 | | | |
| CD47 | 123 | 455 | 787 | 1118 | 1449 | | | |
| HLA-F | 124 | 456 | 788 | 1119 | 1450 | | | |
| OID_5350 | 125 | 457 | 789 | 1120 | 1451 | | | |
| TCRGC2 | 126 | 458 | 790 | 1121 | 1452 | | | |
| OID_7016 | 127 | 459 | 791 | 1122 | | | | |
| PTGS2 | 128 | 460 | 792 | 1123 | 1454 | | | |
| OID_5847 | 129 | 461 | 793 | 1124 | 1455 | | | |
| PRDM1 | 130 | 462 | 794 | 1125 | 1456 | | | |
| CKB | 131 | 463 | 795 | 1126 | 1457 | | | |
| TNNI3 | 132 | 464 | 796 | 1127 | 1458 | | | |

TABLE 2A-continued

| | | | | | | | | |
|---|---|---|---|---|---|---|---|---|
| TNNT2 | 133 | 465 | 797 | 1128 | 1459 | | | |
| MB | 134 | 466 | 798 | 1129 | 1460 | | | |
| SLC7A11 | 135 | 467 | 799 | 1130 | 1461 | | | |
| TNFRSF5 | 136 | 468 | 800 | 1131 | 1462 | 1715 | 1963 | 2211 |
| TNFRSF7 | 137 | 469 | 801 | 1132 | 1463 | | | |
| CD86 | 138 | 470 | 802 | 1133 | 1464 | | | |
| AIF1v2 | 139 | 471 | 803 | 1134 | 1465 | | | |
| EV BCLF-1 | 140 | 472 | 804 | 1135 | 1466 | 1716 | 1964 | 2212 |
| EV EBV | 141 | 473 | 805 | 1136 | 1467 | 1717 | 1965 | 2213 |
| CMV p67 | 142 | 474 | 806 | 1137 | 1468 | 1718 | 1966 | 2214 |
| CMV TRL7 | 143 | 475 | 807 | 1138 | 1469 | 1719 | 1967 | 2215 |
| CMV IE1e3 | 144 | 476 | 808 | 1139 | 1470 | 1720 | 1968 | 2216 |
| CMV IE1e4 | 145 | 477 | 809 | 1140 | 1471 | 1721 | 1969 | 2217 |
| EV EBNA-1 | 146 | 478 | 810 | 1141 | 1472 | 1722 | 1970 | 2218 |
| EV BZLF-1 | 147 | 479 | 811 | 1142 | 1473 | 1723 | 1971 | 2219 |
| EV EBN | 148 | 480 | 812 | 1143 | 1474 | 1724 | 1972 | 2220 |
| EV EBNA-LP | 149 | 481 | 813 | 1144 | 1475 | | | |
| CMV IE1 | 150 | 482 | 814 | 1145 | 1476 | 1725 | 1973 | 2221 |
| CMV IE1 | 151 | 483 | 815 | 1146 | 1477 | | | |
| CLC | 152 | 484 | 816 | 1147 | 1478 | 1726 | 1974 | 2222 |
| TERF2IP | 153 | 485 | 817 | 1148 | 1479 | 1727 | 1975 | 2223 |
| HLA-A | 154 | 486 | 818 | 1149 | 1480 | 1728 | 1976 | 2224 |
| OID_5891 | 155 | 487 | 819 | 1150 | 1481 | 1729 | 1977 | 2225 |
| MSCP | 156 | 488 | 820 | 1151 | 1482 | 1730 | 1978 | 2226 |
| DUSP5 | 157 | 489 | 821 | 1152 | 1483 | 1731 | 1979 | 2227 |
| PRO1853 | 158 | 490 | 822 | 1153 | 1484 | 1732 | 1980 | 2228 |
| OID_6420 | 159 | 491 | 823 | 1154 | 1485 | 1733 | 1981 | 2229 |
| CDSN | 160 | 492 | 824 | 1155 | 1486 | 1734 | 1982 | 2230 |
| OID_4269 | 161 | 493 | 825 | 1156 | 1487 | 1735 | 1983 | 2231 |
| RPS25 | 162 | 494 | 826 | 1157 | 1488 | 1736 | 1984 | 2232 |
| GAPD | 163 | 495 | 827 | 1158 | 1489 | 1737 | 1985 | 2233 |
| RPLP1 | 164 | 496 | 828 | 1159 | 1490 | 1738 | 1986 | 2234 |
| OID_5115 | 165 | 497 | 829 | 1160 | 1491 | 1739 | 1987 | 2235 |
| SLC9A8 | 166 | 498 | 830 | 1161 | 1492 | 1740 | 1988 | 2236 |
| OID_1512 | 167 | 499 | 831 | 1162 | 1493 | 1741 | 1989 | 2237 |
| POLR2D | 168 | 500 | 832 | 1163 | 1494 | 1742 | 1990 | 2238 |
| ARPC3 | 169 | 501 | 833 | 1164 | 1495 | 1743 | 1991 | 2239 |
| OID_6282 | 170 | 502 | 834 | 1165 | 1496 | 1744 | 1992 | 2240 |
| PRO1073 | 171 | 503 | 835 | 1166 | 1497 | 1745 | 1993 | 2241 |
| OID_7222 | 172 | 504 | 836 | 1167 | 1498 | 1746 | 1994 | 2242 |
| FPRL1 | 173 | 505 | 837 | 1168 | 1499 | 1747 | 1995 | 2243 |
| FKBPL | 174 | 506 | 838 | 1169 | 1500 | 1748 | 1996 | 2244 |
| PREB | 175 | 507 | 839 | 1170 | 1501 | 1749 | 1997 | 2245 |
| OID_1551 | 176 | 508 | 840 | 1171 | 1502 | 1750 | 1998 | 2246 |
| OID_7595 | 177 | 509 | 841 | 1172 | 1503 | 1751 | 1999 | 2247 |
| RNF19 | 178 | 510 | 842 | 1173 | 1504 | 1752 | 2000 | 2248 |
| SMCY | 179 | 511 | 843 | 1174 | 1505 | 1753 | 2001 | 2249 |
| OID_4184 | 180 | 512 | 844 | 1175 | 1506 | 1754 | 2002 | 2250 |
| OID_7504 | 181 | 513 | 845 | 1176 | 1507 | 1755 | 2003 | 2251 |
| DNAJC3 | 182 | 514 | 846 | 1177 | 1508 | 1756 | 2004 | 2252 |
| ARHU | 183 | 515 | 847 | 1178 | 1509 | 1757 | 2005 | 2253 |
| OID_7200 | 184 | 516 | 848 | 1179 | 1510 | 1758 | 2006 | 2254 |
| SERPINB2 | 185 | 517 | 849 | 1180 | 1511 | | | |
| ENO1 | 186 | 518 | 850 | 1181 | 1512 | 1759 | 2007 | 2255 |
| OID_7696 | 187 | 519 | 851 | 1182 | 1513 | 1760 | 2008 | 2256 |
| OID_4173 | 188 | 520 | 852 | 1183 | 1514 | 1761 | 2009 | 2257 |
| CSF2RB | 189 | 521 | 853 | 1184 | 1515 | 1762 | 2010 | 2258 |
| OID_7410 | 190 | 522 | 854 | 1185 | 1516 | 1763 | 2011 | 2259 |
| OID_4180 | 191 | 523 | 855 | 1186 | 1517 | 1764 | 2012 | 2260 |
| OID_5101 | 192 | 524 | 856 | 1187 | 1518 | 1765 | 2013 | 2261 |
| MOP3 | 193 | 525 | 857 | 1188 | 1519 | 1766 | 2014 | 2262 |
| RPL18A | 194 | 526 | 858 | 1189 | 1520 | 1767 | 2015 | 2263 |
| INPP5A | 195 | 527 | 859 | 1190 | 1521 | 1768 | 2016 | 2264 |
| hIAN7 | 196 | 528 | 860 | 1191 | 1522 | 1769 | 2017 | 2265 |
| RPS29 | 197 | 529 | 861 | 1192 | 1523 | 1770 | 2018 | 2266 |
| OID_6008 | 198 | 530 | 862 | 1193 | 1524 | 1771 | 2019 | 2267 |
| OID_4186 | 199 | 531 | 863 | 1194 | 1525 | 1772 | 2020 | 2268 |
| VNN2 | 200 | 532 | 864 | 1195 | 1526 | 1773 | 2021 | 2269 |
| OID_7703 | 201 | 533 | 865 | 1196 | 1527 | 1774 | 2022 | 2270 |
| OID_7057 | 202 | 534 | 866 | 1197 | 1528 | 1775 | 2023 | 2271 |
| OID_4291 | 203 | 535 | 867 | 1198 | 1529 | 1776 | 2024 | 2272 |
| OID_1366 | 204 | 536 | 868 | 1199 | 1530 | 1777 | 2025 | 2273 |
| EEF1A1 | 205 | 537 | 869 | 1200 | 1531 | 1778 | 2026 | 2274 |
| PA2G4 | 206 | 538 | 870 | 1201 | 1532 | 1779 | 2027 | 2275 |
| GAPD | 207 | 539 | 871 | 1202 | 1533 | 1780 | 2028 | 2276 |
| CHD4 | 208 | 540 | 872 | 1203 | 1534 | 1781 | 2029 | 2277 |
| OID_7951 | 209 | 541 | 873 | 1204 | 1535 | 1782 | 2030 | 2278 |
| DAB1 | 210 | 542 | 874 | 1205 | 1536 | 1783 | 2031 | 2279 |
| OID_3406 | 211 | 543 | 875 | 1206 | 1537 | 1784 | 2032 | 2280 |

TABLE 2A-continued

| | | | | | | | | |
|---|---|---|---|---|---|---|---|---|
| OID_6986 | 212 | 544 | 876 | 1207 | 1538 | 1785 | 2033 | 2281 |
| OID_5962 | 213 | 545 | 877 | 1208 | 1539 | 1786 | 2034 | 2282 |
| OID_5152 | 214 | 546 | 878 | 1209 | 1540 | 1787 | 2035 | 2283 |
| S100A8 | 215 | 547 | 879 | 1210 | 1541 | 1788 | 2036 | 2284 |
| HNRPU | 216 | 548 | 880 | 1211 | 1542 | 1789 | 2037 | 2285 |
| ERCC5 | 217 | 549 | 881 | 1212 | 1543 | 1790 | 2038 | 2286 |
| RPS27 | 218 | 550 | 882 | 1213 | 1544 | 1791 | 2039 | 2287 |
| ACRC | 219 | 551 | 883 | 1214 | 1545 | 1792 | 2040 | 2288 |
| PSMD11 | 220 | 552 | 884 | 1215 | 1546 | 1793 | 2041 | 2289 |
| OID_1016 | 221 | 553 | 885 | 1216 | 1547 | 1794 | 2042 | 2290 |
| OID_1309 | 222 | 554 | 886 | 1217 | 1548 | 1795 | 2043 | 2291 |
| OID_7582 | 223 | 555 | 887 | 1218 | 1549 | 1796 | 2044 | 2292 |
| OID_4317 | 224 | 556 | 888 | 1219 | 1550 | 1797 | 2045 | 2293 |
| OID_5889 | 225 | 557 | 889 | 1220 | 1551 | 1798 | 2046 | 2294 |
| UBL1 | 226 | 558 | 890 | 1221 | 1552 | 1799 | 2047 | 2295 |
| OID_3687 | 227 | 559 | 891 | 1222 | 1553 | 1800 | 2048 | 2296 |
| OID_7371 | 228 | 560 | 892 | 1223 | 1554 | 1801 | 2049 | 2297 |
| SH3BGRL3 | 229 | 561 | 893 | 1224 | 1555 | 1802 | 2050 | 2298 |
| SEMA7A | 230 | 562 | 894 | 1225 | 1556 | 1803 | 2051 | 2299 |
| OID_5708 | 231 | 563 | 895 | 1226 | 1557 | 1804 | 2052 | 2300 |
| OID_5992 | 232 | 564 | 896 | 1227 | 1558 | 1805 | 2053 | 2301 |
| IL21 | 233 | 565 | 897 | 1228 | 1559 | 1806 | 2054 | 2302 |
| HERC3 | 234 | 566 | 898 | 1229 | 1560 | 1807 | 2055 | 2303 |
| OID_7799 | 235 | 567 | 899 | 1230 | 1561 | 1808 | 2056 | 2304 |
| P11 | 236 | 568 | 900 | 1231 | 1562 | 1809 | 2057 | 2305 |
| OID_7766 | 237 | 569 | 901 | 1232 | 1563 | 1810 | 2058 | 2306 |
| TIMM10 | 238 | 570 | 902 | 1233 | 1564 | 1811 | 2059 | 2307 |
| EGLN1 | 239 | 571 | 903 | 1234 | 1565 | 1812 | 2060 | 2308 |
| TBCC | 240 | 572 | 904 | 1235 | 1566 | 1813 | 2061 | 2309 |
| RNF3 | 241 | 573 | 905 | 1236 | 1567 | 1814 | 2062 | 2310 |
| OID_6451 | 242 | 574 | 906 | 1237 | 1568 | 1815 | 2063 | 2311 |
| CCNDBP1 | 243 | 575 | 907 | 1238 | 1569 | 1816 | 2064 | 2312 |
| OID_8063 | 244 | 576 | 908 | 1239 | 1570 | 1817 | 2065 | 2313 |
| SUV39H1 | 245 | 577 | 909 | 1240 | 1571 | 1818 | 2066 | 2314 |
| HSPC048 | 246 | 578 | 910 | 1241 | 1572 | 1819 | 2067 | 2315 |
| OID_5625 | 247 | 579 | 911 | 1242 | 1573 | 1820 | 2068 | 2316 |
| WARS | 248 | 580 | 912 | 1243 | 1574 | 1821 | 2069 | 2317 |
| OID_6823 | 249 | 581 | 913 | 1244 | 1575 | 1822 | 2070 | 2318 |
| OID_7073 | 250 | 582 | 914 | 1245 | 1576 | 1823 | 2071 | 2319 |
| OID_5339 | 251 | 583 | 915 | 1246 | 1577 | 1824 | 2072 | 2320 |
| OID_4263 | 252 | 584 | 916 | 1247 | 1578 | 1825 | 2073 | 2321 |
| MGC26766 | 253 | 585 | 917 | 1248 | 1579 | 1826 | 2074 | 2322 |
| SERPINB11 | 254 | 586 | 918 | 1249 | 1580 | 1827 | 2075 | 2323 |
| OID_6711 | 255 | 587 | 919 | 1250 | 1581 | 1828 | 2076 | 2324 |
| RNF10 | 256 | 588 | 920 | 1251 | 1582 | 1829 | 2077 | 2325 |
| MKRN1 | 257 | 589 | 921 | 1252 | 1583 | 1830 | 2078 | 2326 |
| RPS16 | 258 | 590 | 922 | 1253 | 1584 | 1831 | 2079 | 2327 |
| BAZ1A | 259 | 591 | 923 | 1254 | 1585 | 1832 | 2080 | 2328 |
| OID_5998 | 260 | 592 | 924 | 1255 | 1586 | 1833 | 2081 | 2329 |
| ATP5L | 261 | 593 | 925 | 1256 | 1587 | 1834 | 2082 | 2330 |
| OID_6393 | 262 | 594 | 926 | 1257 | 1588 | | | |
| RoXaN | 263 | 595 | 927 | 1258 | 1589 | 1835 | 2083 | 2331 |
| NCBP2 | 264 | 596 | 928 | 1259 | 1590 | 1836 | 2084 | 2332 |
| OID_6273 | 265 | 597 | 929 | 1260 | 1591 | 1837 | 2085 | 2333 |
| HZF12 | 266 | 598 | 930 | 1261 | 1592 | 1838 | 2086 | 2334 |
| CCL3 | 267 | 599 | 931 | 1262 | 1593 | 1839 | 2087 | 2335 |
| OID_4323 | 268 | 600 | 932 | 1263 | 1594 | 1840 | 2088 | 2336 |
| OID_5181 | 269 | 601 | | | | | | |
| PRDX4 | 270 | 602 | 933 | 1264 | 1595 | 1841 | 2089 | 2337 |
| BTK | 271 | 603 | 934 | 1265 | 1596 | 1842 | 2090 | 2338 |
| OID_6298 | 272 | 604 | 935 | 1266 | 1597 | 1843 | 2091 | 2339 |
| PGK1 | 273 | 605 | 936 | 1267 | 1598 | 1844 | 2092 | 2340 |
| TNFRSF10A | 274 | 606 | 937 | 1268 | 1599 | 1845 | 2093 | 2341 |
| ADM | 275 | 607 | 938 | 1269 | 1600 | 1846 | 2094 | 2342 |
| OID_357 | 276 | 608 | 939 | 1270 | 1601 | 1847 | 2095 | 2343 |
| C20orf6 | 277 | 609 | 940 | 1271 | 1602 | 1848 | 2096 | 2344 |
| OID_3226 | 278 | 610 | 941 | 1272 | 1603 | 1849 | 2097 | 2345 |
| ASAH1 | 279 | 611 | 942 | 1273 | 1604 | 1850 | 2098 | 2346 |
| ATF5 | 280 | 612 | 943 | 1274 | 1605 | 1851 | 2099 | 2347 |
| OID_4887 | 281 | 613 | 944 | 1275 | 1606 | 1852 | 2100 | 2348 |
| OID_4239 | 282 | 614 | 945 | 1276 | 1607 | 1853 | 2101 | 2349 |
| MDM2 | 283 | 615 | 946 | 1277 | 1608 | 1854 | 2102 | 2350 |
| XRN2 | 284 | 616 | 947 | 1278 | 1609 | 1855 | 2103 | 2351 |
| OID_6039 | 285 | 617 | 948 | 1279 | 1610 | 1856 | 2104 | 2352 |
| OID_4210 | 286 | 618 | 949 | 1280 | 1611 | 1857 | 2105 | 2353 |
| OID_7698 | 287 | 619 | 950 | 1281 | 1612 | 1858 | 2106 | 2354 |
| PRKRA | 288 | 620 | 951 | 1282 | 1613 | 1859 | 2107 | 2355 |
| OID_4288 | 289 | 621 | 952 | 1283 | 1614 | 1860 | 2108 | 2356 |
| OID_5620 | 290 | 622 | 953 | 1284 | 1615 | 1861 | 2109 | 2357 |

TABLE 2A-continued

| | | | | | | | | |
|---|---|---|---|---|---|---|---|---|
| OID_7384 | 291 | 623 | 954 | 1285 | 1616 | 1862 | 2110 | 2358 |
| OID_1209 | 292 | 624 | 955 | 1286 | 1617 | 1863 | 2111 | 2359 |
| CDKN1B | 293 | 625 | 956 | 1287 | 1618 | 1864 | 2112 | 2360 |
| PLOD | 294 | 626 | 957 | 1288 | 1619 | 1865 | 2113 | 2361 |
| OID_5128 | 295 | 627 | 958 | 1289 | 1620 | 1866 | 2114 | 2362 |
| OID_5877 | 296 | 628 | 959 | 1290 | 1621 | 1867 | 2115 | 2363 |
| FZD4 | 297 | 629 | 960 | 1291 | 1622 | 1868 | 2116 | 2364 |
| HLA-B | 298 | 630 | 961 | 1292 | 1623 | 1869 | 2117 | 2365 |
| OID_5624 | 299 | 631 | 962 | 1293 | 1624 | 1870 | 2118 | 2366 |
| FPR1 | 300 | 632 | 963 | 1294 | 1625 | 1871 | 2119 | 2367 |
| ODF2 | 301 | 633 | 964 | 1295 | 1626 | 1872 | 2120 | 2368 |
| OID_5150 | 302 | 634 | 965 | 1296 | 1627 | 1873 | 2121 | 2369 |
| OID_5639 | 303 | 635 | 966 | 1297 | 1628 | 1874 | 2122 | 2370 |
| OID_6619 | 304 | 636 | 967 | 1298 | 1629 | 1875 | 2123 | 2371 |
| OID_6933 | 305 | 637 | 968 | 1299 | 1630 | 1876 | 2124 | 2372 |
| OID_7049 | 306 | 638 | 969 | 1300 | 1631 | 1877 | 2125 | 2373 |
| IL17C | 307 | 639 | 970 | 1301 | 1632 | 1878 | 2126 | 2374 |
| OID_5866 | 308 | 640 | 971 | 1302 | 1633 | 1879 | 2127 | 2375 |
| CD44 | 309 | 641 | 972 | 1303 | 1634 | 1880 | 2128 | 2376 |
| VPS45A | 310 | 642 | 973 | 1304 | 1635 | 1881 | 2129 | 2377 |
| OID_4932 | 311 | 643 | 974 | 1305 | 1636 | 1882 | 2130 | 2378 |
| OID_7821 | 312 | 644 | 975 | 1306 | 1637 | 1883 | 2131 | 2379 |
| OID_4916 | 313 | 645 | 976 | 1307 | 1638 | 1884 | 2132 | 2380 |
| OID_4891 | 314 | 646 | 977 | 1308 | 1639 | 1885 | 2133 | 2381 |
| HADHB | 315 | 647 | 978 | 1309 | 1640 | 1886 | 2134 | 2382 |
| FLJ22757 | 316 | 648 | 979 | 1310 | 1641 | 1887 | 2135 | 2383 |
| RAC1 | 317 | 649 | 980 | 1311 | 1642 | 1888 | 2136 | 2384 |
| OID_6415 | 318 | 650 | 981 | 1312 | 1643 | 1889 | 2137 | 2385 |
| NMES1 | 319 | 651 | 982 | 1313 | 1644 | 1890 | 2138 | 2386 |
| DMBT1 | 320 | 652 | 983 | 1314 | 1645 | 1891 | 2139 | 2387 |
| RPS23 | 321 | 653 | 984 | 1315 | 1646 | 1892 | 2140 | 2388 |
| ZF | 322 | 654 | 985 | 1316 | 1647 | 1893 | 2141 | 2389 |
| NFE2L3 | 323 | 655 | 986 | 1317 | 1648 | 1894 | 2142 | 2390 |
| RAD9 | 324 | 656 | 987 | 1318 | 1649 | 1895 | 2143 | 2391 |
| OID_6295 | 325 | 657 | 988 | 1319 | 1650 | 1896 | 2144 | 2392 |
| DEFCAP | 326 | 658 | 989 | 1320 | 1651 | 1897 | 2145 | 2393 |
| RPL27A | 327 | 659 | 990 | 1321 | 1652 | 1898 | 2146 | 2394 |
| IL22 | 328 | 660 | 991 | 1322 | 1653 | 1899 | 2147 | 2395 |
| PSMA4 | 329 | 661 | 992 | 1323 | 1654 | 1900 | 2148 | 2396 |
| CCNI | 330 | 662 | 993 | 1324 | 1655 | 1901 | 2149 | 2397 |
| THBD | 331 | 663 | 994 | 1325 | 1656 | 1902 | 2150 | 2398 |
| CGR19 | 332 | 664 | 995 | 1326 | 1657 | 1903 | 2151 | 2399 |

| Gene | Gene Name | SEQ ID 50mer | SEQ ID RNA/cDNA | n | Non-parametric Odds ratio | Fisher p-value | t-test p-value |
|---|---|---|---|---|---|---|---|
| HBB | Hemoglobin, beta | 86 | 418 | 55 | 8.33 | 0.00 | 0.00 |
| OID_4365 | Mitochondrial solute carrier | 91 | 423 | 53 | 6.16 | 0.00 | 0.00 |
| OID_873 | KIAA1892 protein | 94 | 426 | 55 | 5.09 | 0.01 | 0.01 |
| IL4 | Interleukin 4 | 80 | 412 | 46 | 4.90 | 0.02 | 0.01 |
| OID_4281 | EST | 107 | 439 | 56 | 5.19 | 0.01 | 0.01 |
| IGHM | Immunoglobulin heavy constant mu | 92 | 424 | 52 | 2.89 | 0.09 | 0.01 |
| BPGM | 2,3-bisphosphoglycerate mutase | 87 | 419 | 43 | 7.31 | 0.01 | 0.01 |
| CTLA4 | Cytotoxic T-lymphocyte-associated protein 4 | 82 | 414 | 52 | 1.84 | | 0.02 |
| SLC7A11 | Solute carrier family 7, (cationic amino acid transporter, y+ system) member 11 | 135 | 467 | 48 | 2.50 | 0.15 | 0.03 |
| IL13 | Interleukin 13 | 81 | 413 | 29 | 4.95 | 0.07 | 0.04 |
| OID_6207 | EST | 105 | 437 | 37 | 3.58 | 0.10 | 0.04 |
| PRDM1 | PR domain containing 1, with ZNF domain | 130 | 462 | 57 | 1.44 | | 0.07 |
| LYN | v-yes-1 Yamaguchi sarcoma viral related oncogene homolog | 102 | 434 | 55 | 1.08 | | 0.08 |
| KPNA6 | Karyopherin alpha 6 (importin alpha 7) | 90 | 422 | 51 | 1.50 | | 0.09 |
| OID_7094 | XDx EST 479G12 | 118 | 450 | 35 | 1.13 | | 0.09 |
| IL15 | Interleukin 15 | 111 | 443 | 51 | 3.78 | 0.05 | 0.09 |
| OID_4460 | EST | 85 | 417 | 47 | 2.73 | 0.14 | 0.10 |

TABLE 2A-continued

| | | | | | | | |
|---|---|---|---|---|---|---|---|
| OID_7016 | EST | 127 | 459 | 53 | 2.14 | 0.27 | 0.10 |
| MTHFD2 | Methylene tetrahydrofolate dehydrogenase (NAD+ dependent), methenyltetrahydrofolate cyclohydrolase | 88 | 420 | 43 | 3.50 | 0.07 | 0.11 |
| TCIRG1 | T-cell, immune regulator 1, ATPase, H+ transporting, lysosomal V0 protein a isoform 3 | 78 | 410 | 57 | 1.08 | | 0.11 |
| OID_5847 | Hypothetical protein FLJ32919 | 129 | 461 | 45 | 1.08 | | 0.12 |
| CXCR4 | Chemokine (C-X-C motif) | 96 | 428 | 56 | 1.29 | | 0.12 |
| CXCR3 | Chemokine (C-X-C motif) | 117 | 449 | 54 | 2.10 | 0.27 | 0.12 |
| GPI | Glucose phosphate isomer | 122 | 454 | 57 | 1.44 | 0.60 | 0.12 |
| KLRF1 | Killer cell lectin-like rece | 101 | 433 | 50 | 1.68 | | 0.13 |
| CCL5 | Chemokine (C-C motif) 1 | 98 | 430 | 34 | 1.96 | | 0.13 |
| CD47 | CD47 antigen (Rh-related) | 123 | 455 | 55 | 1.45 | | 0.13 |
| IL10 | Interleukin 10 | 112 | 444 | 33 | 1.43 | | 0.13 |
| OID_253 | EST | 121 | 453 | 26 | 1.93 | | 0.15 |
| CXCL10 | Chemokine (C-X-C motif) | 109 | 441 | 53 | 1.75 | | 0.16 |
| IFNG | Interferon, gamma | 113 | 445 | 41 | 1.33 | | 0.16 |
| PRF1 | Perforin 1 (pore forming | 79 | 411 | 48 | 1.20 | | 0.17 |
| IL2 | Interleukin 2 | 100 | 432 | 33 | 2.00 | | 0.17 |
| HLA-DRB1 | Major histocompatibility | 114 | 446 | 42 | 1.50 | | 0.18 |
| IL6 | Interleukin 6 | 99 | 431 | 49 | 1.33 | | 0.18 |
| IL2RA | Interleukin 2 receptor, alpha | 103 | 435 | 39 | 2.03 | 0.34 | 0.19 |
| OID_573 | KIAA1486 protein | 93 | 425 | 8 | 3.00 | | 0.19 |
| CXCL9 | Chemokine (C-X-C motif) ligand 9 (MIG) | 108 | 440 | 46 | 1.71 | | 0.20 |
| OID_3 | EST | 95 | 427 | 49 | 2.19 | | 0.20 |
| CD8B1 | CD8 antigen, beta polypeptide 1 (p37) | 115 | 447 | 55 | 1.21 | | 0.22 |
| CD69 | CD69 antigen (p60, early T-cell activation antigen) | 97 | 429 | 30 | 1.71 | | 0.23 |
| OID_7605 | EST | 119 | 451 | 47 | 3.11 | 0.08 | 0.24 |
| TNFSF6 | Tumor necrosis factor (ligand) superfamily, member 6 | 77 | 409 | 54 | 1.36 | | 0.25 |
| CXCL1 | Chemokine (C-X-C motif) ligand 1 (melanoma growth stimulating activity, alpha) | 120 | 452 | 20 | 2.00 | | 0.26 |
| OID_5350 | EST | 125 | 457 | 49 | 2.08 | 0.26 | 0.28 |
| CD8A | CD8 antigen, alpha polypeptide (p32) | 83 | 415 | 57 | 1.39 | | 0.28 |
| CD4 | CD4 antigen (p55) | 116 | 448 | 55 | 1.64 | | 0.28 |
| PTGS2 | Prostaglandin-endoperoxide synthase 2 (prostaglandin G/H synthase and cyclooxygenase) | 128 | 460 | 46 | 2.05 | 0.37 | 0.29 |
| GZMB | Granzyme B (granzyme 2, cytotoxic T-lymphocyte-associated serine esterase 1) | 76 | 408 | 40 | 1.81 | | 0.33 |
| CCL4 | Chemokine (C-C motif) ligand 4, SCYA4 | 104 | 436 | 53 | 2.25 | | 0.35 |
| ChGn | Chondroitin beta 1,4 N-acetylgalactosaminyl-transferase | 106 | 438 | 31 | 2.57 | | 0.36 |
| TCRGC2 | T cell receptor gamma constant 2 | 126 | 458 | 52 | 1.33 | | 0.39 |
| HLA-F | Major histocompatibility complex, class I, F | 124 | 456 | 54 | 2.36 | 0.17 | 0.40 |
| TAP1 | Transporter 1, ATP-binding cassette, sub-family B (MDR1/TAP) | 89 | 421 | 36 | 1.93 | | 0.45 |
| BY55 | Natural killer cell receptor, immunoglobulin superfamily member | 84 | 416 | 52 | 2.49 | 0.16 | 0.48 |

TABLE 2A-continued

| Gene | ACC | SEQ ID 50mer | SEQ ID RNA/cDNA | | RefSeq Peptide Accession # | | SEQ ID Protein |
|---|---|---|---|---|---|---|---|
| IL8 | Interleukin 8 | 75 | 407 | 49 | 2.10 | 0.26 | 0.49 |

| Gene | ACC | SEQ ID 50mer | SEQ ID RNA/cDNA | RefSeq Peptide Accession # | SEQ ID Protein |
|---|---|---|---|---|---|
| ACTB | NM_001101 | 2 | 334 | NP_001092 | 2400 |
| GUSB | NM_000181 | 3 | 335 | NP_000172 | 2401 |
| B2M | NM_004048 | 4 | 336 | NP_004039 | 2402 |
| TSN | NM_004622 | 5 | 337 | NP_004613 | 2403 |
| CCR7 | NM_001838 | 6 | 338 | NP_001829 | 2404 |
| IL1R2 | NM_004633 | 7 | 339 | NP_004624 | 2405 |
| AIF-1 | NM_004847 | 8 | 340 | NP_004838 | 2406 |
| ALAS2 | NM_000032.1 | 9 | 341 | NP_000023 | 2407 |
| APELIN | NM_017413 | 10 | 342 | NP_059109 | 2408 |
| CD80 | NM_005191 | 11 | 343 | NP_005182 | 2409 |
| EPB41 | NM_004437 | 12 | 344 | NP_004428 | 2410 |
| CBLB | NM_004351 | 13 | 345 | NP_733762 | 2411 |
| CCR5 | NM_000579 | 14 | 346 | NP_000570 | 2412 |
| MME | NM_000902 | 15 | 347 | NP_000893 | 2413 |
| KLRC1 | NM_002259 | 16 | 348 | NP_002250 | 2414 |
| FCGR3A | NM_000569 | 17 | 349 | NP_000560 | 2415 |
| FCGR3B | NM_000570 | 18 | 350 | NP_000561 | 2416 |
| LAG3 | NM_002286 | 19 | 351 | NP_002277 | 2417 |
| PECAM1 | NM_000442 | 20 | 352 | NP_000433 | 2418 |
| CD34 | NM_001773 | 21 | 353 | NP_001764 | 2419 |
| FCGR1A | NM_000566 | 22 | 354 | NP_000557 | 2420 |
| TFRC | NM_003234 | 23 | 355 | NP_003225 | 2421 |
| CMA1 | NM_001836 | 24 | 356 | NP_001827 | 2422 |
| KIT | NM_000222 | 25 | 357 | NP_000213 | 2423 |
| MPL | NM_005373 | 26 | 358 | NP_005364 | 2424 |
| EphB6 | NM_004445 | 27 | 359 | NP_004436 | 2425 |
| EPO-R | NM_000121.2 | 28 | 360 | NP_000112 | 2426 |
| Foxp3 | NM_014009 | 29 | 361 | NP_054728 | 2427 |
| GATA-1 | NM_002049 | 30 | 362 | NP_002040 | 2428 |
| ITGA2B | NM_000419 | 31 | 363 | NP_000410 | 2429 |
| GNLY | NM_006433 | 32 | 364 | NP_006424 | 2430 |
| GZMA | NM_006144 | 33 | 365 | NP_006135 | 2431 |
| HBA | NM_000558.3 | 34 | 366 | NP_000549 | 2432 |
| HBZ | NM_005332.2 | 35 | 367 | NP_005323 | 2433 |
| HBD | NM_000519.2 | 37 | 369 | NP_000510 | 2434 |
| HBE | NM_005330 | 38 | 370 | NP_005321 | 2435 |
| HBG | NM_000559.2 | 39 | 371 | NP_000550 | 2436 |
| HBQ | NM_005331 | 40 | 372 | NP_005322 | 2437 |
| HLA-DP | NM_033554 | 41 | 373 | NP_291032 | 2438 |
| HLA-DQ | NM_002122 | 42 | 374 | NP_002113 | 2439 |
| ICOS | NM_012092 | 44 | 376 | NP_036224 | 2440 |
| IL18 | NM_001562 | 45 | 377 | NP_001553 | 2441 |
| IL3 | NM_000588 | 46 | 378 | NP_000579 | 2442 |
| ITGA4 | NM_000885 | 47 | 379 | NP_000876 | 2443 |
| ITGAM | NM_000632 | 48 | 380 | NP_000623 | 2444 |
| ITGB7 | NM_000889 | 49 | 381 | NP_000880 | 2445 |
| CEBPB | NM_005194 | 50 | 382 | NP_005185 | 2446 |
| NF-E2 | NM_006163 | 51 | 383 | NP_006154 | 2447 |
| PDCD1 | NM_005018 | 52 | 384 | NP_005009 | 2448 |
| PF4 | NM_002619 | 53 | 385 | NP_002610 | 2449 |
| PRKCQ | NM_006257.1 | 54 | 386 | NP_006248 | 2450 |
| PPARGC1 | NM_013261 | 55 | 387 | NP_037393 | 2451 |
| RAG1 | NM_000448 | 56 | 388 | NP_000439 | 2452 |
| RAG2 | NM_000536 | 57 | 389 | NP_000527 | 2453 |
| CXCL12 | NM_000609 | 58 | 390 | NP_000600 | 2454 |
| TNFRSF4 | NM_003327 | 59 | 391 | NP_003318 | 2455 |
| TNFSF4 | NM_003326 | 60 | 392 | NP_003317 | 2456 |
| TPS1 | NM_003293 | 61 | 393 | NP_003284 | 2457 |
| ADA | NM_000022 | 62 | 394 | NP_000013 | 2458 |
| CPM | NM_001874.1 | 63 | 395 | NP_001865 | 2459 |
| CSF2 | NM_000758.2 | 64 | 396 | NP_000749 | 2460 |
| CSF3 | NM_172219 | 65 | 397 | NP_757373 | 2461 |
| CRP | NM_000567.1 | 66 | 398 | NP_000558 | 2462 |
| FLT3 | NM_004119 | 67 | 399 | NP_004110 | 2463 |
| GATA3 | NM_002051.1 | 68 | 400 | NP_002042 | 2464 |
| IL7R | NM_002185.1 | 69 | 401 | NP_002176 | 2465 |
| KLF1 | NM_006563.1 | 70 | 402 | NP_006554 | 2466 |
| LCK | NM_005356.2 | 71 | 403 | NP_005347 | 2467 |
| LEF1 | NM_016269.1 | 72 | 404 | NP_057353 | 2468 |
| PLAUR | NM_002659.1 | 73 | 405 | NP_002650 | 2469 |
| TNFSF13B | NM_006573.3 | 74 | 406 | NP_006564 | 2470 |
| IL8 | NM_000584 | 75 | 407 | NP_000575 | 2471 |
| GZMB | NM_004131 | 76 | 408 | NP_004122 | 2472 |
| TNFSF6 | NM_000639 | 77 | 409 | NP_000630 | 2473 |

TABLE 2A-continued

| | | | | | |
|---|---|---|---|---|---|
| TCIRG1 | NM_006019 | 78 | 410 | NP_006010 | 2474 |
| PRF1 | NM_005041 | 79 | 411 | NP_005032 | 2475 |
| IL4 | NM_000589 | 80 | 412 | NP_000580 | 2476 |
| IL13 | NM_002188 | 81 | 413 | NP_002179 | 2477 |
| CTLA4 | NM_005214 | 82 | 414 | NP_005205 | 2478 |
| CD8A | NM_001768 | 83 | 415 | NP_001759 | 2479 |
| BY55 | NM_007053 | 84 | 416 | NP_008984 | 2480 |
| HBB | NM_000518 | 86 | 418 | NP_000509 | 2481 |
| BPGM | NM_001724 | 87 | 419 | NP_001715 | 2482 |
| MTHFD2 | NM_006636 | 88 | 420 | NP_006627 | 2483 |
| TAP1 | NM_000593 | 89 | 421 | NP_000584 | 2484 |
| OID_873 | AK000354 | 94 | 426 | NP_056212 | 2485 |
| CXCR4 | NM_003467 | 96 | 428 | NP_003458 | 2486 |
| CD69 | NM_001781 | 97 | 429 | NP_001772 | 2487 |
| CCL5 | NM_002985 | 98 | 430 | NP_002976 | 2488 |
| IL6 | NM_000600 | 99 | 431 | NP_000591 | 2489 |
| IL2 | NM_000586 | 100 | 432 | NP_000577 | 2490 |
| KLRF1 | NM_016523 | 101 | 433 | NP_057607 | 2491 |
| LYN | NM_002350 | 102 | 434 | NP_002341 | 2492 |
| IL2RA | NM_000417 | 103 | 435 | NP_000408 | 2493 |
| CCL4 | NM_002984 | 104 | 436 | NP_002975 | 2494 |
| ChGn | NM_018371 | 106 | 438 | NP_060841 | 2495 |
| CXCL9 | NM_002416 | 108 | 440 | NP_002407 | 2496 |
| CXCL10 | NM_001565 | 109 | 441 | NP_001556 | 2497 |
| IL17 | NM_002190 | 110 | 442 | NP_002181 | 2498 |
| IL15 | NM_000585 | 111 | 443 | NP_000576 | 2499 |
| IL10 | NM_000572 | 112 | 444 | NP_000563 | 2500 |
| IFNG | NM_000619 | 113 | 445 | NP_000610 | 2501 |
| HLA-DRB1 | NM_002124 | 114 | 446 | NP_002115 | 2502 |
| CD8B1 | NM_004931 | 115 | 447 | NP_004922 | 2503 |
| CD4 | NM_000616 | 116 | 448 | NP_000607 | 2504 |
| CXCR3 | NM_001504 | 117 | 449 | NP_001495 | 2505 |
| CXCL1 | NM_001511 | 120 | 452 | NP_001502 | 2506 |
| GPI | NM_000175 | 122 | 454 | NP_000166 | 2507 |
| CD47 | NM_001777 | 123 | 455 | NP_001768 | 2508 |
| HLA-F | NM_018950 | 124 | 456 | NP_061823 | 2509 |
| PTGS2 | NM_000963 | 128 | 460 | NP_000954 | 2510 |
| OID_5847 | NM_144588 | 129 | 461 | NP_653189 | 2511 |
| PRDM1 | NM_001198 | 130 | 462 | NP_001189 | 2512 |
| CKB | NM_001823 | 131 | 463 | NP_001814 | 2513 |
| TNNI3 | NM_000363 | 132 | 464 | NP_000354 | 2514 |
| TNNT2 | NM_000364 | 133 | 465 | NP_000355 | 2515 |
| MB | NM_005368 | 134 | 466 | NP_005359 | 2516 |
| SLC7A11 | NM_014331 | 135 | 467 | NP_055146 | 2517 |
| TNFRSF5 | NM_001250 | 136 | 468 | NP_001241 | 2518 |
| TNFRSF7 | NM_001242 | 137 | 469 | NP_001233 | 2519 |
| CD86 | NM_175862 | 138 | 470 | NP_787058 | 2520 |
| AIF1v2 | NM_004847 | 139 | 471 | NP_004838 | 2521 |
| CMV IE1e3 | NC_001347, compl | 144 | 476 | NP_040060 | 2522 |
| CMV IE1e4 | NC_001347, compl | 145 | 477 | NP_040060 | 2523 |
| EV EBNA-1 | NC_001345, 10795 | 146 | 478 | NP_039875 | 2524 |
| EV BZLF-1 | NC_001345, compl | 147 | 479 | NP_039871 | 2525 |
| CMV IE1 | NC_001347, compl | 150 | 482 | NP_040060 | 2526 |
| CMV IE1 | NC_001347, compl | 151 | 483 | NP_040060 | 2527 |
| CLC | NM_001828 | 152 | 484 | NP_001819 | 2528 |
| TERF2IP | NM_018975 | 153 | 485 | NP_061848 | 2529 |
| HLA-A | NM_002116 | 154 | 486 | NP_002107 | 2530 |
| MSCP | NM_018579 | 156 | 488 | NP_061049 | 2531 |
| DUSP5 | NM_004419 | 157 | 489 | NP_004410 | 2532 |
| PRO1853 | NM_018607 | 158 | 490 | NP_061077 | 2533 |
| CDSN | NM_001264 | 160 | 492 | NP_001255 | 2534 |
| RPS25 | NM_001028 | 162 | 494 | NP_001019 | 2535 |
| GAPD | NM_002046 | 163 | 495 | NP_002037 | 2536 |
| RPLP1 | NM_001003 | 164 | 496 | NP_000994 | 2537 |
| POLR2D | NM_004805 | 168 | 500 | NP_004796 | 2538 |
| ARPC3 | NM_005719 | 169 | 501 | NP_005710 | 2539 |
| FPRL1 | NM_001462 | 173 | 505 | NP_001453 | 2540 |
| FKBPL | NM_022110 | 174 | 506 | NP_071393 | 2541 |
| PREB | NM_013388 | 175 | 507 | NP_037520 | 2542 |
| OID_7595 | NM_015653 | 177 | 509 | NP_056468 | 2543 |
| RNF19 | NM_015435 | 178 | 510 | NP_056250 | 2544 |
| SMCY | NM_004653 | 179 | 511 | NP_004644 | 2545 |
| OID_7504 | NM_152312 | 181 | 513 | NP_689525 | 2546 |
| DNAJC3 | NM_006260 | 182 | 514 | NP_006251 | 2547 |
| ARHU | NM_021205 | 183 | 515 | NP_067028 | 2548 |
| OID_7200 | NM_022752 | 184 | 516 | NP_073589 | 2549 |
| SERPINB2 | NM_002575 | 185 | 517 | NP_002566 | 2550 |
| ENO1 | NM_001428 | 186 | 518 | NP_001419 | 2551 |
| MOP3 | NM_018183 | 193 | 525 | NP_060653 | 2552 |

TABLE 2A-continued

| | | | | | |
|---|---|---|---|---|---|
| RPL18A | NM_000980 | 194 | 526 | NP_000971 | 2553 |
| INP_P5A | NM_005539 | 195 | 527 | NP_005530 | 2554 |
| RPS29 | NM_001032 | 197 | 529 | NP_001023 | 2555 |
| VNN2 | NM_004665 | 200 | 532 | NP_004656 | 2556 |
| OID_7703 | NM_014949 | 201 | 533 | NP_055764 | 2557 |
| EEF1A1 | NM_001402 | 205 | 537 | NP_001393 | 2558 |
| PA2G4 | NM_006191 | 206 | 538 | NP_006182 | 2559 |
| GAPD | NM_002046 | 207 | 539 | NP_002037 | 2560 |
| CHD4 | NM_001273 | 208 | 540 | NP_001264 | 2561 |
| OID_7951 | NM_016521 | 209 | 541 | NP_057605 | 2562 |
| DAB1 | NM_021080 | 210 | 542 | NP_066566 | 2563 |
| OID_3406 | NM_018986 | 211 | 543 | NP_061859 | 2564 |
| S100A8 | NM_002964 | 215 | 547 | NP_002955 | 2565 |
| ERCC5 | NM_000123 | 217 | 549 | NP_000114 | 2566 |
| RPS27 | NM_001030 | 218 | 550 | NP_001021 | 2567 |
| ACRC | NM_052957 | 219 | 551 | NP_443189 | 2568 |
| UBL1 | NM_003352 | 226 | 558 | NP_003343 | 2569 |
| SH3BGRL3 | NM_031286 | 229 | 561 | NP_112576 | 2570 |
| SEMA7A | NM_003612 | 230 | 562 | NP_003603 | 2571 |
| IL21 | NM_021803 | 233 | 565 | NP_068575 | 2572 |
| HERC3 | NM_014606 | 234 | 566 | NP_055421 | 2573 |
| P11 | NM_006025 | 236 | 568 | NP_006016 | 2574 |
| TIMM10 | NM_012456 | 238 | 570 | NP_036588 | 2575 |
| EGLN1 | AJ310543 | 239 | 571 | NP_071334 | 2576 |
| TBCC | NM_003192 | 240 | 572 | NP_003183 | 2577 |
| RNF3 | NM_006315 | 241 | 573 | NP_006306 | 2578 |
| CCNDBP1 | NM_012142 | 243 | 575 | NP_036274 | 2579 |
| SUV39H1 | NM_003173 | 245 | 577 | NP_003164 | 2580 |
| HSPC048 | NM_014148 | 246 | 578 | NP_054867 | 2581 |
| WARS | NM_004184 | 248 | 580 | NP_004175 | 2582 |
| SERPINB11 | NM_080475 | 254 | 586 | NP_536723 | 2583 |
| RNF10 | NM_014868 | 256 | 588 | NP_055683 | 2584 |
| MKRN1 | NM_013446 | 257 | 589 | NP_038474 | 2585 |
| RPS16 | NM_001020 | 258 | 590 | NP_001011 | 2586 |
| BAZ1A | NM_013448 | 259 | 591 | NP_038476 | 2587 |
| ATP5L | NM_006476 | 261 | 593 | NP_006467 | 2588 |
| NCBP2 | NM_007362 | 264 | 596 | NP_031388 | 2589 |
| HZF12 | NM_033204 | 266 | 598 | NP_149981 | 2590 |
| CCL3 | D90144 | 267 | 599 | NP_002974 | 2591 |
| PRDX4 | NM_006406 | 270 | 602 | NP_006397 | 2592 |
| BTK | NM_000061 | 271 | 603 | NP_000052 | 2593 |
| PGK1 | NM_000291 | 273 | 605 | NP_000282 | 2594 |
| TNFRSF10A | NM_003844 | 274 | 606 | NP_003835 | 2595 |
| ADM | NM_001124 | 275 | 607 | NP_001115 | 2596 |
| C20orf6 | NM_016649 | 277 | 609 | NP_057733 | 2597 |
| OID_3226 | NM_015393 | 278 | 610 | NP_056208 | 2598 |
| ASAH1 | NM_004315 | 279 | 611 | NP_004306 | 2599 |
| ATF5 | NM_012068 | 280 | 612 | NP_036200 | 2600 |
| OID_4887 | NM_032895 | 281 | 613 | NP_116284 | 2601 |
| MDM2 | NM_002392 | 283 | 615 | NP_002383 | 2602 |
| XRN2 | AF064257 | 284 | 616 | NP_036387 | 2603 |
| PRKRA | NM_003690 | 288 | 620 | NP_003681 | 2604 |
| CDKN1B | NM_004064 | 293 | 625 | NP_004055 | 2605 |
| PLOD | NM_000302 | 294 | 626 | NP_000293 | 2606 |
| FZD4 | NM_012193 | 297 | 629 | NP_036325 | 2607 |
| HLA-B | NM_005514 | 298 | 630 | NP_005505 | 2608 |
| FPR1 | NM_002029 | 300 | 632 | NP_002020 | 2609 |
| ODF2 | NM_153437 | 301 | 633 | NP_702915 | 2610 |
| IL17C | NM_013278 | 307 | 639 | NP_037410 | 2611 |
| VPS45A | NM_007259 | 310 | 642 | NP_009190 | 2612 |
| HADHB | NM_000183 | 315 | 647 | NP_000174 | 2613 |
| FLJ22757 | NM_024898 | 316 | 648 | NP_079174 | 2614 |
| NMES1 | NM_032413 | 319 | 651 | NP_115789 | 2615 |
| DMBT1 | NM_007329 | 320 | 652 | NP_015568 | 2616 |
| RPS23 | NM_001025 | 321 | 653 | NP_001016 | 2617 |
| ZF | NM_021212 | 322 | 654 | NP_067035 | 2618 |
| NFE2L3 | NM_004289 | 323 | 655 | NP_004280 | 2619 |
| RAD9 | NM_004584 | 324 | 656 | NP_004575 | 2620 |
| DEFCAP | NM_014922 | 326 | 658 | NP_055737 | 2621 |
| IL22 | NM_020525 | 328 | 660 | NP_065386 | 2622 |
| PSMA4 | NM_002789 | 329 | 661 | NP_002780 | 2623 |
| CCNI | NM_006835 | 330 | 662 | NP_006826 | 2624 |
| THBD | NM_000361 | 331 | 663 | NP_000352 | 2625 |
| CGR19 | NM_006568 | 332 | 664 | NP_006559 | 2626 |
| HSRRN18S | X03205 | 1 | 333 | | |
| HBB | NG_000007 | 36 | 368 | | |
| HLA-DRB | | 43 | 375 | | |
| OID_4460 | AF150295 | 85 | 417 | | |
| KPNA6 | AW021037 | 90 | 422 | | |

TABLE 2A-continued

| | | | |
|---|---|---|---|
| OID_4365 | AI114652 | 91 | 423 |
| IGHM | BC032249 | 92 | 424 |
| OID_573 | AB040919 | 93 | 425 |
| OID_3 | AW968823 | 95 | 427 |
| OID_6207 | D20522 | 105 | 437 |
| OID_4281 | AA053887 | 107 | 439 |
| OID_7094 | | 118 | 450 |
| OID_7605 | AA808018 | 119 | 451 |
| OID_253 | AK091125 | 121 | 453 |
| OID_5350 | AK055687 | 125 | 457 |
| TCRGC2 | M17323 | 126 | 458 |
| OID_7016 | BI018696 | 127 | 459 |
| EV EBV | | 141 | 473 |
| CMV p67 | NC_001347 | 142 | 474 |
| CMV TRL7 | | 143 | 475 |
| EV EBN | | 148 | 480 |
| EV EBNA-LP | | 149 | 481 |
| OID_5891 | AW297949 | 155 | 487 |
| OID_6420 | AK090404 | 159 | 491 |
| OID_4269 | BM727677 | 161 | 493 |
| OID_5115 | AI364926 | 165 | 497 |
| SLC9A8 | AB023156 | 166 | 498 |
| OID_1512 | BE618004 | 167 | 499 |
| OID_6282 | BC041913 | 170 | 502 |
| PRO1073 | AF001542 | 171 | 503 |
| OID_7222 | BG260891 | 172 | 504 |
| OID_1551 | BE887646 | 176 | 508 |
| OID_4184 | X17403 | 180 | 512 |
| OID_7696 | AW297325 | 187 | 519 |
| OID_4173 | X17403 | 188 | 520 |
| CSF2RB | AL540399 | 189 | 521 |
| OID_7410 | AW837717 | 190 | 522 |
| OID_4180 | X17403 | 191 | 523 |
| OID_5101 | BG461987 | 192 | 524 |
| hIAN7 | BG772661 | 196 | 528 |
| OID_6008 | AW592876 | 198 | 530 |
| OID_4186 | X17403 | 199 | 531 |
| OID_7057 | 480F8 | 202 | 534 |
| OID_4291 | 8C038439 | 203 | 535 |
| OID_1366 | AW850041 | 204 | 536 |
| OID_6986 | AK093608 | 212 | 544 |
| OID_5962 | AW452467 | 213 | 545 |
| OID_5152 | AI392805 | 214 | 546 |
| HNRPU | BM467823 | 216 | 548 |
| PSMD11 | AI684022 | 220 | 552 |
| OID_1016 | AK024456 | 221 | 553 |
| OID_1309 | AV706481 | 222 | 554 |
| OID_7582 | AK027866 | 223 | 555 |
| OID_4317 | AI318342 | 224 | 556 |
| OID_5889 | AW297843 | 225 | 557 |
| OID_3687 | W03955 | 227 | 559 |
| OID_7371 | BE730505 | 228 | 560 |
| OID_5708 | AW081540 | 231 | 563 |
| OID_5992 | AW467992 | 232 | 564 |
| OID_7799 | AW837717 | 235 | 567 |
| OID_7766 | AW294711 | 237 | 569 |
| OID_6451 | AL834168 | 242 | 574 |
| OID_8063 | X68264 | 244 | 576 |
| OID_5625 | AW063780 | 247 | 579 |
| OID_6823 | AL832642 | 249 | 581 |
| OID_7073 | AL705961 | 250 | 582 |
| OID_5339 | AI625119 | 251 | 583 |
| OID_4263 | AA136584 | 252 | 584 |
| MGC26766 | AK025472 | 253 | 585 |
| OID_6711 | BF968628 | 255 | 587 |
| OID_5998 | AW468459 | 260 | 592 |
| OID_6393 | 52B9 | 262 | 594 |
| RoXaN | BC004857 | 263 | 595 |
| OID_6273 | AW294774 | 265 | 597 |
| OID_4323 | AA744774 | 268 | 600 |
| OID_5181 | AI400725 | 269 | 601 |
| OID_6298 | AI948513 | 272 | 604 |
| OID_357 | 138G5 | 276 | 608 |
| OID_4239 | BQ022840 | 282 | 614 |
| OID_6039 | BE502246 | 285 | 617 |
| OID_4210 | AI300700 | 286 | 618 |
| OID_7698 | AA243283 | 287 | 619 |
| OID_4288 | AI378046 | 289 | 621 |
| OID_5620 | AW063678 | 290 | 622 |

TABLE 2A-continued

| | | | |
|---|---|---|---|
| OID_7384 | BF475239 | 291 | 623 |
| OID_1209 | C14379 | 292 | 624 |
| OID_5128 | AK097845 | 295 | 627 |
| OID_5877 | AW297664 | 296 | 628 |
| OID_5624 | AW063921 | 299 | 631 |
| OID_5150 | AI392793 | 302 | 634 |
| OID_5639 | AW064243 | 303 | 635 |
| OID_6619 | 469A10 | 304 | 636 |
| OID_6933 | AI089520 | 305 | 637 |
| OID_7049 | 480E2 | 306 | 638 |
| OID_5866 | BM684739 | 308 | 640 |
| CD44 | AA916990 | 309 | 641 |
| OID_4932 | AA457757 | 311 | 643 |
| OID_7821 | AA743221 | 312 | 644 |
| OID_4916 | AA252909 | 313 | 645 |
| OID_4891 | AL832329 | 314 | 646 |
| RAC1 | AK054993 | 317 | 649 |
| OID_6415 | CA407201 | 318 | 650 |
| OID_6295 | AI880607 | 325 | 657 |
| RPL27A | BF214146 | 327 | 659 |

TABLE 3

Viral genomes were used to design oligonucleotides for the microarrays. The accession numbers for the viral genomes used are given, along with the gene name and location of the region used for oligonucleotide design.

| Virus | Gene Name | Genome Location |
|---|---|---|
| Adenovirus, type 2 Accession #J01917 | E1a | 1226 ... 1542 |
| | E1b_1 | 3270 ... 3503 |
| | E2a_2 | complement(24089 ... 25885) |
| | E3-1 | 27609 ... 29792 |
| | E4 (last exon at 3'-end) | complement(33193 ... 32802) |
| | IX | 3576 ... 4034 |
| | Iva2 | complement(4081 ... 5417) |
| | DNA Polymerase | complement(5187 ... 5418) |
| Cytomegalovirus (CMV) Accession #X17403 | HCMVTRL2 (IRL2) | 1893 ... 2240 |
| | HCMVTRL7 (IRL7) | complement(6595 ... 6843) |
| | HCMVUL21 | complement(26497 ... 27024) |
| | HCMVUL27 | complement(32831 ... 34657) |
| | HCMVUL33 | 43251 ... 44423 |
| | HCMVUL54 | complement(76903 ... 80631) |
| | HCMVUL75 | complement(107901 ... 110132) |
| | HCMVUL83 | complement(119352 ... 121037) |
| | HCMVUL106 | complement(154947 ... 155324) |
| | HCMVUL109 | complement(157514 ... 157810) |
| | HCMVUL113 | 161503 ... 162800 |
| | HCMVUL122 | complement(169364 ... 170599) |
| | HCMVUL123 (last exon at 3'-end) | complement(171006 ... 172225) |
| | HCMVUS28 | 219200 ... 220171 |
| Epstein-Barr virus (EBV) Accession # NC_001345 | Exon in EBNA-1 RNA | 67477 ... 67649 |
| | Exon in EBNA-1 RNA | 98364 ... 98730 |
| | BRLF1 | complement(103366 ... 105183) |
| | BZLF1 (first of 3 exons) | complement(102655 ... 103155) |
| | BMLF1 | complement(82743 ... 84059) |
| | BALF2 | complement(161384 ... 164770) |
| Human Herpesvirus 6 (HHV6) Accession #NC_001664 | U16/U17 | complement(26259 ... 27349) |
| | U89 | complement(133091 ... 135610) |
| | U90 | complement(135664 ... 135948) |
| | U86 | complement(125989 ... 128136) |
| | U83 | 123528 ... 123821 |
| | U22 | complement(33739 ... 34347) |
| | DR2 (DR2L) | 791 ... 2653 |
| | DR7 (DR7L) | 5629 ... 6720 |
| | U95 | 142941 ... 146306 |
| | U94 | complement(141394 ... 142866) |
| | U39 | complement(59588 ... 62080) |
| | U42 | complement(69054 ... 70598) |
| | U81 | complement(121810 ... 122577) |
| | U91 | 136485 ... 136829 |

TABLE 4

Dependent variables for discovery of gene expression markers of cardiac allograft rejection.

| Dependent Variable | Description | Number of Rejection Samples | Number of No-Rejection Samples |
|---|---|---|---|
| 0 vs 1-4 Bx | Grade 0 vs. Grades 1-4, local biopsy reading | 65 | 114 |
| s0 vs 1B-4 HG | Stable Grade 0 vs Grades 1B-4, highest grade, Grade 1A not included | 41 | 57 |
| 0-1A vs 1B-4 HG | Grades 0 and 1A vs Grades 1B-4, highest grade. | 121 | 58 |
| 0 vs 3A HG | Grade 0 vs Grade 3A, highest grade. Grades 1A-2 and Grade 3B were not included. | 56 | 29 |
| 0 vs 1B-4 | Grade 0 vs Grades 1B-4, highest grade. Grade 1A was not included. | 57 | 57 |
| 0 vs 1A-4 | Grade 0 vs. Grades 1-4, highest grade | 56 | 123 |

TABLE 5

Real-time PCR assay chemistries. Various combinations of reporter and quencher dyes are useful for real-time PCR assays.

| Reporter | Quencher |
|---|---|
| FAM | TAMRA |
| | BHQ1 |
| TET | TAMRA |
| | BHQ1 |
| JOE | TAMRA |
| | BHQ1 |

TABLE 5-continued

Real-time PCR assay chemistries. Various combinations of reporter and quencher dyes are useful for real-time PCR assays.

| Reporter | Quencher |
|---|---|
| HEX | TAMRA |
|  | BHQ1 |
| VIC | TAMRA |
|  | BHQ1 |
| ROX | BHQ2 |
| TAMRA | BHQ2 |

TABLE 6

Real-time PCR results for rejection markers

| Gene Array Probe SEQ ID | Phase 1 Fold | Phase 1 t-Test | Phase 1 NR | Phase 1 R | Phase 2 Fold | Phase 2 t-Test | Phase 2 NR | Phase 2 R | All Data Fold | All Data t-Test | All Data NR | All Data R |
|---|---|---|---|---|---|---|---|---|---|---|---|---|
| 95 | 1.093 | 0.36084 | 10 | 8 | | | | | 0.935 | 0.31648 | 21 | 13 |
| 111 | 1.415 | 0.0095 | 12 | 10 | | | | | 1.415 | 0.0095 | 12 | 10 |
| 79 | 1.822 | 0.01146 | 6 | 7 | 0.63 | 0.04185 | 19 | 15 | 0.72 | 0.05632 | 35 | 26 |
| 3016 | 1.045 | 0.41017 | 12 | 10 | | | | | 1.001 | 0.49647 | 16 | 15 |
| 75 | 0.84 | 0.36674 | 11 | 8 | 0.595 | 0.15788 | 16 | 13 | 0.628 | 0.08402 | 34 | 26 |
| 2765 | 1.653 | 0.01508 | 10 | 10 | 0.776 | 0.11082 | 19 | 14 | 0.956 | 0.37421 | 38 | 29 |
| 97 | | | | | 0.75 | 0.26201 | 8 | 8 | 0.543 | 0.11489 | 17 | 12 |
| 2635 | 1.553 | 0.00533 | 13 | 10 | 0.834 | 0.16853 | 18 | 15 | 0.988 | 0.46191 | 36 | 27 |
| 96 | 1.495 | 0.06288 | 13 | 9 | 1.157 | 0.27601 | 18 | 15 | 1.155 | 0.21096 | 33 | 25 |
| 100 | 1.43 | 0.166 | 10 | 5 | | | | | 1.408 | 0.14418 | 12 | 8 |
| 2766 | 0.956 | 0.43918 | 12 | 10 | 0.989 | 0.48275 | 19 | 14 | 0.978 | 0.45101 | 31 | 24 |
| 2726 | 1.037 | 0.38205 | 11 | 9 | | | | | 1.037 | 0.38205 | 11 | 9 |
| 2768 | 1.211 | 0.02386 | 9 | 9 | | | | | 1.211 | 0.02386 | 9 | 9 |
| 94 | 1.601 | 0.02418 | 11 | 10 | | | | | 1.831 | 0.00094 | 17 | 15 |
| 2769 | 1.133 | 0.23094 | 12 | 9 | 1.081 | 0.19632 | 19 | 15 | 1.101 | 0.15032 | 31 | 24 |
| 2770 | 1.734 | 0.00017 | 13 | 10 | | | | | 1.381 | 0.01323 | 20 | 15 |
| 2647 | 1.557 | 0.04502 | 10 | 8 | | | | | 1.557 | 0.04502 | 10 | 8 |
| 2771 | 1.99 | 0.05574 | 13 | 9 | | | | | 1.52 | 0.11108 | 17 | 13 |
| 82 | 2.029 | 0.00022 | 8 | 5 | 1.287 | 0.13022 | 18 | 14 | 1.256 | 0.05356 | 33 | 23 |
| 83 | 1.546 | 0.05865 | 13 | 10 | 0.577 | 0.03934 | 18 | 14 | 0.795 | 0.11993 | 39 | 26 |
| 98 | | | | | 0.716 | 0.13 | 19 | 15 | 0.577 | 0.03352 | 19 | 14 |
| 36 | 1.605 | 0.09781 | 12 | 8 | 2.618 | 0.01227 | 18 | 11 | 2.808 | 0.00015 | 38 | 23 |
| 80 | 5.395 | 0.00049 | 9 | 6 | 4.404 | 0.05464 | 10 | 10 | 2.33 | 0.02369 | 29 | 18 |
| 89 | | | | | | | | | 0.295 | 0.02856 | 6 | 6 |
| 77 | 1.894 | 0.01602 | 10 | 10 | 0.537 | 0.01516 | 19 | 15 | 0.863 | 0.21987 | 35 | 29 |
| 2772 | 1.583 | 0.06276 | 10 | 6 | 0.714 | 0.13019 | 13 | 10 | 1.136 | 0.28841 | 28 | 17 |
| 2773 | 1.391 | 0.09236 | 11 | 6 | | | | | 1.391 | 0.09236 | 11 | 6 |
| 2774 | 1.59 | 0.00022 | 13 | 10 | | | | | 1.59 | 0.00022 | 13 | 10 |
| 102 | 1.245 | 0.05079 | 11 | 10 | 1.018 | 0.42702 | 17 | 15 | 1.117 | 0.08232 | 32 | 28 |
| 2775 | 0.719 | 0.16243 | 11 | 9 | | | | | 0.719 | 0.16243 | 11 | 9 |
| 2776 | 1.257 | 0.0516 | 12 | 9 | | | | | 1.257 | 0.0516 | 12 | 9 |
| 2667 | 1.343 | 0.03806 | 13 | 9 | | | | | 1.13 | 0.15962 | 20 | 12 |
| 115 | 1.199 | 0.26299 | 11 | 9 | | | | | 1.199 | 0.26299 | 11 | 9 |
| 2669 | 2.146 | 0.00813 | 12 | 10 | | | | | 1.296 | 0.14285 | 18 | 12 |
| 2777 | 1.142 | 0.20245 | 13 | 10 | | | | | 1.142 | 0.20245 | 13 | 10 |
| 78 | 1.324 | 0.01985 | 12 | 9 | 0.967 | 0.33851 | 18 | 14 | 1.007 | 0.46864 | 38 | 24 |
| 2670 | 1.388 | 0.11209 | 13 | 9 | | | | | 1.388 | 0.11209 | 13 | 9 |
| 88 | 1.282 | 0.14267 | 7 | 7 | 0.995 | 0.48504 | 17 | 14 | 1.008 | 0.47383 | 30 | 23 |
| 2778 | 1.128 | 0.19528 | 13 | 9 | | | | | 1.128 | 0.19528 | 13 | 9 |
| 2779 | 1.991 | 0.02513 | 9 | 5 | 0.642 | 0.05002 | 18 | 14 | 0.868 | 0.26275 | 32 | 21 |
| 2780 | 1.597 | 0.00355 | 13 | 10 | 0.802 | 0.11649 | 17 | 14 | 1.013 | 0.45521 | 38 | 26 |
| 2781 | | | | | 0.492 | 0.01344 | 12 | 12 | 0.819 | 0.25555 | 17 | 15 |
| 101 | | | | | 0.652 | 0.04317 | 19 | 15 | 0.773 | 0.09274 | 29 | 22 |
| 106 | 1.234 | 0.19141 | 13 | 8 | | | | | 1.234 | 0.19141 | 13 | 8 |
| 2683 | 1.598 | 0.03723 | 8 | 8 | 0.633 | 0.03893 | 14 | 10 | 0.86 | 0.18731 | 28 | 22 |
| 2782 | 1.213 | 0.03305 | 12 | 10 | 0.912 | 0.07465 | 19 | 15 | 0.969 | 0.31955 | 39 | 27 |
| 87 | | | | | 4.947 | 0.02192 | 18 | 15 | 3.857 | 0.00389 | 30 | 23 |
| 99 | 0.639 | 0.06613 | 7 | 5 | 0.839 | 0.30304 | 16 | 8 | 0.694 | 0.04347 | 27 | 15 |
| 2692 | 0.801 | 0.21236 | 12 | 8 | 0.893 | 0.33801 | 18 | 15 | 0.782 | 0.06938 | 38 | 25 |
| 104 | 2.292 | 0.0024 | 11 | 8 | 0.621 | 0.05152 | 19 | 15 | 0.913 | 0.34506 | 30 | 23 |
| 76 | 1.809 | 0.00893 | 9 | 8 | 0.693 | 0.13027 | 13 | 8 | 1.274 | 0.11887 | 28 | 19 |
| 91 | 1.969 | 0.07789 | 11 | 8 | 4.047 | 0.00812 | 19 | 13 | 3.535 | 0.00033 | 37 | 23 |
| 92 | 2.859 | 0.05985 | 11 | 8 | 9.783 | 0.03047 | 18 | 14 | 8.588 | 0.00192 | 37 | 24 |
| 85 | 0.95 | 0.43363 | 12 | 8 | 0.699 | 0.0787 | 13 | 13 | 0.633 | 0.01486 | 33 | 24 |
| 126 | 1.76 | 0.02199 | 11 | 10 | | | | | 1.76 | 0.02199 | 11 | 10 |

TABLE 6-continued

Real-time PCR results for rejection markers

| Gene Array Probe SEQ ID | Phase 1 Fold | Phase 1 t-Test | Phase 1 NR | Phase 1 R | Phase 2 Fold | Phase 2 t-Test | Phase 2 NR | Phase 2 R | All Data Fold | All Data t-Test | All Data NR | All Data R |
|---|---|---|---|---|---|---|---|---|---|---|---|---|
| 2783 | 0.945 | 0.46023 | 10 | 5 | 0.852 | 0.26701 | 17 | 10 | 0.986 | 0.48609 | 29 | 17 |
| 2707 | 1.055 | 0.31435 | 13 | 10 | | | | | 1.055 | 0.31435 | 13 | 10 |
| 123 | 1.154 | 0.11677 | 11 | 10 | | | | | 1.154 | 0.11677 | 11 | 10 |
| 84 | 1.786 | 0.00255 | 9 | 6 | 0.523 | 0.04965 | 18 | 14 | 0.785 | 0.14976 | 34 | 22 |
| 2784 | 2.12 | 0.00022 | 12 | 10 | 0.498 | 0.01324 | 18 | 13 | 0.935 | 0.37356 | 37 | 25 |
| 2785 | 1.181 | 0.1377 | 10 | 10 | | | | | 1.181 | 0.1377 | 10 | 10 |
| 124 | 1.353 | 0.08122 | 11 | 9 | | | | | 1.353 | 0.08122 | 11 | 9 |
| 90 | 1.355 | 0.02288 | 13 | 10 | 0.973 | 0.39248 | 15 | 13 | 1.125 | 0.08671 | 28 | 23 |
| 2786 | 1.306 | 0.0773 | 12 | 10 | | | | | 1.306 | 0.0773 | 12 | 10 |
| 2787 | 1.086 | 0.32378 | 12 | 10 | | | | | 1.086 | 0.32378 | 12 | 10 |
| 3018 | 1.523 | 0.1487 | 12 | 10 | 0.84 | 0.27108 | 18 | 13 | 1.101 | 0.33276 | 36 | 26 |
| 125 | 1.252 | 0.05782 | 11 | 10 | | | | | 1.252 | 0.05782 | 11 | 10 |
| 2788 | 1.255 | 0.1221 | 11 | 10 | | | | | 1.255 | 0.1221 | 11 | 10 |
| 2789 | 1.152 | 0.31252 | 9 | 6 | | | | | 1.152 | 0.31252 | 9 | 6 |
| 3019 | 1.268 | 0.21268 | 6 | 7 | 0.981 | 0.45897 | 16 | 10 | 1.012 | 0.46612 | 29 | 19 |
| 2790 | 0.881 | 0.17766 | 11 | 8 | 1.22 | 0.04253 | 18 | 10 | 0.966 | 0.33826 | 40 | 23 |
| 2791 | 1.837 | 0.00553 | 13 | 10 | | | | | 1.837 | 0.00553 | 13 | 10 |
| 3020 | 1.271 | 0.10162 | 12 | 10 | 0.853 | 0.10567 | 19 | 13 | 0.965 | 0.36499 | 36 | 25 |
| 2792 | 1.504 | 0.05096 | 12 | 10 | 0.713 | 0.02979 | 19 | 15 | 0.846 | 0.16914 | 31 | 25 |
| 2793 | 1.335 | 0.03133 | 12 | 10 | 0.883 | 0.18577 | 19 | 15 | 0.916 | 0.23865 | 36 | 27 |
| 2794 | 1.936 | 0.00176 | 13 | 9 | 0.717 | 0.09799 | 19 | 14 | 0.877 | 0.22295 | 40 | 25 |
| 2752 | 1.499 | 0.03077 | 12 | 8 | 0.808 | 0.15363 | 17 | 13 | 1.004 | 0.48903 | 36 | 23 |
| 2795 | 0.815 | 0.24734 | 8 | 5 | 0.965 | 0.41772 | 19 | 15 | 0.938 | 0.3265 | 32 | 22 |
| 119 | 1.272 | 0.20279 | 10 | 10 | | | | | 1.272 | 0.20279 | 10 | 10 |

TABLE 7

Significance analysis for microarrays for identification of markers of acute rejection. In each case the highest grade from the 3 pathologists was taken for analysis. No rejection and rejection classes are defined. Samples are either used regardless of redundancy with respect to patients or a requirement is made that only one sample is used per patient or per patient per class. The number of samples used in the analysis is given and the lowest FDR achieved is noted.

| No Rejection | Rejection | # Samples | Low FDR |
|---|---|---|---|
| All Samples | | | |
| Grade 0 | Grade 3A-4 | 148 | 1 |
| Grade 0 | Grade 1B, 3A-4 | 158 | 1.5 |
| Non-redundant within class | | | |
| Grade 0 | Grade 3A-4 | 86 | 7 |
| Grade 0 | Grade 1B, 3A-4 | 93 | 16 |
| Non-redundant (1 sample/patient) | | | |
| Grade 0 | Grade 3A-4 | 73 | 11 |

TABLE 8

Renal rejection tissue gene expression SAM analysis

| Array probe ID | Gene | FDR | Protein SEQ ID | Leukocyte expression | Secreted |
|---|---|---|---|---|---|
| 2697 | CD69 antigen (p60, early T-cell activat | 1.5625 | 2925 | + | |
| 2645 | Ras association (RalGDS/AF-6) | 1.5625 | 2926 | | |
| 2707 | CD33 antigen (gp67) (CD33), mRNA | 1.5625 | 2927 | + | |
| 2679 | Ras association (RalGDS/AF-6) domain fa | 1.5625 | 2928 | | |
| 2717 | EST, 5 end | 1.5625 | | | |

TABLE 8-continued

Renal rejection tissue gene expression SAM analysis

| Array probe ID | Gene | FDR | Protein SEQ ID | Leukocyte expression | Secreted |
|---|---|---|---|---|---|
| 2646 | mRNA for KIAA0209 gene, partial cds/cd | 1.5625 | 2929 | | |
| 2667 | leupaxin (LPXN), mRNA/cds = (93,1253) | 1.5625 | 2930 | + | |
| 2706 | c- EST 3 end/clone = IMAGE: | 2.1111 | | | |
| 2740 | c- insulin induced gene 1 (INSIG1), mRNA | 2.2 | | | |
| 117 | chemokine (C-X-C motif) receptor 3 | 2.8125 | 2931 | | |
| 2669 | IL2-inducible T-cell kinase (ITK), mRNA | 2.8125 | 2932 | + | |
| 2674 | glioma pathogenesis-related protein (RT | 2.8125 | 2933 | | |
| 2743 | c- nuclear receptor subfamily 1, group I | 2.8125 | | | |
| 326 | death effector filament-forming Ced-4-I | 2.8125 | 2934 | | |
| 2716 | EST cDNA, 3 end | 2.8125 | | | |
| 2727 | c- chemokine (C-X-C motif), receptor 4 | 3.1316 | 2935 | + | |
| 2721 | c- EST 3 end/clone = IMAGE: | 3.1316 | | | |
| 2641 | hypothetical protein FLJ20647 (FLJ20647 | 3.1316 | 2936 | | |
| 2671 | tumor necrosis factor, alpha-induced pr | 3.525 | 2937 | | |
| 2752 | protein tyrosine phosphatase, receptor | 3.8077 | 2938 | + | |
| 2737 | 7f37g03.x1 cDNA, 3 end/clone = IMAGE: | 3.8077 | | | |
| 2719 | c- EST372075 cDNA | 3.8077 | | | |
| 2684 | molecule possessing ankyrin repeats ind | 3.8077 | 2939 | | |
| 76 | granzyme B (granzyme 2, cytotoxic T-lym | 3.8077 | 2940 | + | + |
| 2677 | lectin-like NK cell receptor (LLT1), mR | 3.8077 | 2941 | + | |
| 2748 | c-107G11 | 3.9 | | | |
| 2703 | c- EST, 5 end/clone = IMAGE | 3.9 | | | |
| 2711 | SAM domain, SH3 domain and nuclear | 3.9 | 2942 | | |
| 2663 | phosphodiesterase 4B, cAMP-specific | 3.9 | 2943 | | + |
| 98 | small inducible cytokine A5 (RANTES) | 4.5645 | 2944 | + | + |
| 2657 | tumor necrosis factor receptor superfam | 4.8286 | 2945 | | |
| 2683 | B-cell lymphoma/leukaemia 11B (BCL11B) | 4.8286 | 2946 | + | |
| 2686 | phospholipase A2, group VII (platelet-a | 4.8286 | 2947 | | + |
| 2687 | phosphatidylinositol 3-kinase catalytic | 4.8286 | 2948 | | |
| 2644 | AV659177 cDNA, 3 end | 4.9028 | | | |
| 2664 | regulator of G-protein signalling 10 (R | 5.0238 | 2949 | | |
| 2747 | c- integral membrane protein 2A (ITM2A), | 5.0238 | 2950 | | |
| 2744 | c- interferon consensus sequence binding | 5.0238 | | | |
| 2678 | HSPC022 protein (HSPC022), mRNA | 5.0238 | 2951 | | |
| 2731 | c- xj98c03.x1 NCI_CGAP Co18 cDNA | 5.0238 | | | |
| 2713 | caspase recruitment domain protein 9 (L | 5.0238 | 2952 | | |
| 2736 | c- small inducible cytokine A4 (homologo | 5.1395 | 2953 | + | + |
| 2708 | major histocompatibility complex, class | 5.15 | 2954 | | |
| 249 | c-107H8 | 5.15 | | | |
| 2670 | CD72 antigen (CD72), mRNA | 5.15 | 2955 | + | |
| 2661 | heat shock 70kD protein 6 (HDP70B) | 5.15 | 2956 | | |
| 2680 | bridging integrator 2 (BIN2), mRNA/cds | 5.15 | 2957 | | |
| 2754 | UI-H-BW0-aiy-b-10-0-UI.s1 cDNA,3 end | 5.15 | | | |
| 2728 | c- EST380762 cDNA | 5.15 | | | |
| 174 | FKBPL | 5.15 | 2958 | | |
| 2742 | c- chromobox homolog 3 (DM) | 5.15 | | | |
| 2668 | basement membrane-induced gene(ICB-1) | 5.15 | 2959 | | |
| 2750 | Lysosomal-assoc. multispanning memb | 5.15 | 2960 | | |
| 2746 | 174D1 | 5.15 | | | |
| 2738 | c-AV716627 cDNA, 5 end | 5.15 | | | |
| 2627 | solute carrier family 17 (sodium phosph | 5.15 | 2961 | | |
| 2739 | c- asparaginyl-tRNA synthetase (NARS) | 5.15 | | | |
| 124 | major histocompatibility complex, class | 5.15 | 2962 | | |
| 2647 | mRNA for T-cell specific protein/cds | 5.15 | 2963 | + | |
| 2628 | c-EST, 3 end | 5.2295 | | | |
| 2638 | Express cDNA library cDNA 5 | 5.2903 | | | |
| 2725 | c- 601571679F1 cDNA, 5 end | 5.3385 | 2964 | | |
| 2714 | gg78c05.x1 cDNA, 3 end/clone | 5.3385 | 2965 | | |
| 2635 | interleukin 2 receptor gamma chain | 5.3385 | 2966 | + | |
| 2751 | 7264, lectin, galactoside-binding, soluble | 5.4167 | 2967 | | + |
| 2629 | 8, cDNA: FLJ21559 fis, clone COL06406 | 5.5299 | 2968 | | |
| 2695 | mRNA; cDNA DKFZp434E0516 | 5.5588 | 2969 | | |
| 2741 | c- hexokinase 2 (HK2), mRNA | 5.5986 | | | |
| 41 | Similar to major histocompatibility antigen | 5.5986 | 2970 | | |
| 2691 | CD5 antigen (p56-62) (CD5) | 5.5986 | 2971 | | |
| 2726 | c- 602650370T1 cDNA, 3 | 5.6014 | | | |
| 2722 | c- EST cDNA clone | 5.6014 | | | |
| 2689 | interleukin-2 receptor | 5.6014 | 2972 | | |
| 2734 | c- nuclear receptor subfamily 1, group I | 5.6667 | | | |
| 2631 | pre-B-cell colony-enhancing factor | 5.7566 | 2973 | | + |
| 2656 | postmeiotic segregation increased | 5.7756 | 2974 | | |
| 2696 | protein tyrosine phosphatase, receptor | 5.7756 | 2975 | | |
| 2676 | butyrophilin, subfamily 3, member A2 | 5.8165 | 2976 | | |

TABLE 8-continued

Renal rejection tissue gene expression SAM analysis

| Array probe ID | Gene | FDR | Protein SEQ ID | Leukocyte expression | Secreted |
|---|---|---|---|---|---|
| 2701 | c- EST 3 end | 5.9048 | | | |
| 2730 | EST 3 end/clone = IMAGE | 5.9048 | | | |
| 2710 | high affin. immunoglobulin epsilon recept. | 5.9048 | 2977 | | |
| 2632 | encoding major histocompatibility comple | 5.9048 | 2978 | | |
| 2724 | c- EST 3 end | 5.9048 | | | |
| 2698 | EST | 6.0353 | | | |
| 2662 | interferon regulatory factor 1 (IRF1), | 6.0988 | 2979 | | |
| 139 | allograft inflammatory factor 1 (AIF1), | 6.1379 | 2980 | | |
| 2753 | platelet activating receptor homolog (H | 6.3182 | 2981 | | |
| 2704 | c- EST 3 end/clone = IMAGE: | 7.0337 | | | |
| 2675 | pim-2 oncogene (PIM2), mRNA | 7.1222 | 2982 | | + |
| 2700 | proteoglycan 1, secretory granule (PRG1 | 7.375 | 2983 | | + |
| 2640 | mRNA for KIAA0870 protein, partial cds | 7.375 | 2984 | | |
| 2723 | c- EST, 5 end /clone = IMAGE | 7.375 | | | |
| 2658 | FYN-binding protein (FYB-120/130) (FYB) | 7.375 | 2985 | | |
| 2688 | major histocompatibility complex, class | 7.375 | 2986 | | |
| 2735 | c- EST, 3 end/clone = IMAGE: | 7.375 | | | |
| 2702 | c- hypothetical protein MGC4707 | 7.634 | | | |
| 2681 | hypothetical protein FLJ10652 | 8.1117 | 2987 | | |
| 2755 | EST, 3 end | 8.1117 | | | |
| 2715 | hypothetical protein FLJ10842 | 8.1117 | | | |
| 2732 | c-EST cDNA, 3 end | 8.1117 | | | |
| 2652 | hexokinase 2 (HK2), mRNA | 8.1117 | | | |
| 2651 | colony stimulating factor 3 receptor | 8.1117 | 2988 | | |
| 2718 | RNA binding motif protein, X chrom | 8.2788 | | | |
| 2673 | Src-like-adapter (SLA), mRNA | 8.3048 | 2989 | | |
| 2733 | c- major histocompatibility complex | 8.467 | | | |
| 2712 | histamine receptor H2 (HRH2) | 8.8583 | 2990 | | |
| 2659 | hemopoietic cell kinase (HCK) | 8.8583 | 2991 | | |
| 2654 | xanthene dehydrogenase (XDH) | 8.8583 | 2992 | | |
| 2636 | Arabidopsis root cap 1 | 8.8583 | 2993 | | |
| 2639 | fatty acid binding protein 1, liver | 8.8583 | | | |
| 2690 | adenosine deaminase (ADA) | 8.8583 | 2994 | | |
| 2705 | c- EST, 3 end | 8.8583 | 2995 | | |
| 2685 | hypothetical protein MGC10823 | 8.8583 | 2996 | | |
| 2692 | membrane-spanning 4-domains, | 8.8583 | 2997 | | |
| 2693 | rearranged immunoglobulin mRNA for mu | 8.8583 | | | + |
| 2648 | protein tyrosine kinase related mRNA | 8.8583 | | | |
| 2650 | major histocompatibility complex, class | 8.8583 | 2998 | | |
| 2720 | c- EST 3 end/clone = IMAGE: | 8.8583 | | | |
| 2660 | major histocompatibility complex, class | 8.8583 | 2999 | | |
| 2666 | BCL2-related protein A1 (BCL2A1), mRNA | 9.1446 | 3000 | | |
| 2699 | c-EST | 9.4767 | | | |
| 2633 | interleukin 4 receptor | 9.4767 | 3001 | | |
| 74 | tumor necrosis factor (ligand) superfam | 9.4767 | 3002 | | |
| 2672 | interferon-induced, hepatitis C-assoc. | 9.4767 | 3003 | | |
| 2642 | cDNA FLJ20673 fis, clone KAIA4464 | 9.4767 | 3004 | | |
| 2682 | VNN3 protein (HSA238982), mRNA | 9.4767 | 3005 | | |
| 2655 | cathepsin K (pycnodysostosis) (CTSK) | 9.4767 | 3006 | | |
| 2630 | Integrin, alpha L (CD11A (p180), lymphoc | 9.4767 | 3007 | | |
| 2745 | EST, 5 end | 9.4885 | 3008 | | |
| 2643 | nuclear receptor subfamily 1, group I, | 9.625 | | | |
| 2694 | CDW52 antigen (CAMPATH-1) | 9.625 | 3009 | | |
| 2749 | 6977, c-178F5 | 9.6903 | 3010 | | |
| 2665 | small inducible cytokine subfamily A | 9.6903 | 3011 | | |
| 2649 | signal transducer and activator | 9.7878 | 3012 | | |
| 2637 | 324, | 9.7878 | | | |
| 2634 | 70 activation (Act-2) mRNA | 9.7878 | 3013 | | |
| 2709 | coagulation factor VII | 9.7878 | 3014 | | |
| 2653 | integrin, beta 2 (antigen CD18 (p95) | 9.7878 | 3015 | | |
| 2729 | EST 3' end | 9.8321 | | | |

TABLE 9

| Array Probe SEQ ID | Gene | Gene Name | mRNA Accession # | RefSeq Peptide Accession # | Current UniGene Cluster (Build 156) | Localization | Function |
|---|---|---|---|---|---|---|---|
| 111 | IL15 | Interleukin 15 | NM_000585 | NP_000576 | Hs.168132 | Secreted | T-cell activation and proliferation |
| 79 | PRF1 | Perforin 1 (pore forming protein) | NM_005041 | NP_005032 | Hs.2200 | Secreted | CD8, CTL effector; channel-forming protein capable of lysing non-specifically a variety of target cells; clearance of virally infected host cells and tumor cells; |
| 110 | IL17 | Interleukin 17 (cytotoxic T-lymphocyte-associated serine esterase 8) | NM_002190 | NP_002181 | Hs.41724 | Secreted | Induces stromal cells to produce proinflammatory and hematopoietic cytokines; enhances IL6, IL8 and ICAM-1 expression in fibroblasts; osteoclastic bone resorption in RA; expressed in only in activated CD4 + T cells |
| 75 | IL8 | Interleukin 8 | NM_000584 | NP_000575 | Hs.624 | Secreted | Proinflammatory cytokine |
| 120 | CXCL1 | Chemokine (C-X-C motif) ligand 1 (melanoma growth stimulating activity, alpha) | NM_001511 | NP_001502 | Hs.789 | Secreted | Neurogenesis, immune system development, signaling |
| 113 | IFNG | Interferon, gamma | NM_000619 | NP_000610 | Hs.856 | Secreted | Antiviral defense and immune activation |
| 100 | IL2 | Interleukin 2 | NM_000586 | NP_000577 | Hs.89679 | Secreted | Promotes growth of B and T cells |
| 4 | B2M | beta 2 microglobulin | NM_004048 | NP_004039 | Hs.75415 | Secreted | |
| 98 | CCL5 | Chemokine (C-C motif) ligand 5 (RANTES, SCYA5) | NM_002985 | NP_002976 | Hs.241392 | Secreted | Chemoattractant for monocytes, memory T helper cells and eosinophils; causes release of histamine from basophils and activates eosinophils; One of the major HIV-suppressive factors produced by CD8+ cells |
| 112 | IL10 | Interleukin 10 | NM_000572 | NP_000563 | Hs.193717 | Secreted | Chemotactic factor for CD8 + T cells; down-regulates expression of Th1 cytokines, MHC class II Ags, and costimulatory molecules on macrophages; enhances B cell survival, proliferation, and antibody production; blocks NF kappa B, JAK-STAT regulation; |
| 80 | IL4 | Interleukin 4 | NM_000589 | NP_000580 | Hs.73917 | Secreted | TH2, cytokine, stimulates CTL |
| 2773 | IL7 | Interleukin 7 | NM_000880 | NP_000871 | Hs.72927 | Secreted | Proliferation of lymphoid progenitors |
| 109 | CXCL10 | Chemokine (C-X-C motif) ligand 10, SCYB10 | NM_001565 | NP_001556 | Hs.2248 | Secreted | Stimulation of monocytes, NK and T cell migration, modulation of adhesion molecule expression |
| 2665 | CCL17 | Chemokine (C-C motif) ligand 17 | NM_002987 | NP_002978 | Hs.66742 | Secreted | T cell development, trafficking and activation |
| 101 | KLRF1 | Killer cell lectin-like receptor subfamily F, member 1 | NM_016523 | NP_057607 | Hs.183125 | Secreted | Induction of IgE, IgG4, CD23, CD72, surface IgM, and class II MHC antigen in B cells |
| 99 | IL6 | Interleukin 6 | NM_000600 | NP_000591 | Hs.93913 | Secreted | B cell maturation |
| 104 | CCL4 | Chemokine (C-C motif) ligand 4 | NM_002984 | NP_002975 | Hs.75703 | Secreted | Inflammatory and chemokinetic properties; one of the major HIV-suppressive factors produced by CD8 + T cells |

TABLE 9-continued

| Array Probe SEQ ID | Gene | Gene Name | mRNA Accession # | RefSeq Peptide Accession # | Current UniGene Cluster (Build 156) | Localization | Function |
|---|---|---|---|---|---|---|---|
| 76 | GZMB | Granzyme B (granzyme 2, cytotoxic T-lymphocyte-associated serine esterase 1) | NM_004131 | NP_004122 | Hs.1051 | Secreted | Apoptosis; CD8, CTL effector |
| 2785 | OID_4789 | KIAA0963 protein | NM_014963 | NP_055778 | Hs.7724 | Secreted | Proinflammatory; chemoattraction and activation of neutrophils |
| 2791 | XCL1 | Chemokine (C motif) ligand 1 (SCYC2) | NM_002995 | NP_002986 | Hs.3195 | Secreted | Chemotactic factor for lymphocytes but not monocytes or neutrophils |
| 130 | PRDM1 | PR domain containing 1, with ZNF domain | NM_001198 | NP_001189 | Hs.388346 | Nuclear | Transcription factor; promotes B cell maturation, represses human beta-IFN gene expression |
| 2781 | TBX21 | T-box 21 | NM_013351 | NP_037483 | Hs.272409 | Nuclear | TH1 differentiation, transcription factor |
| 88 | MTHFD2 | Methylene tetrahydrofolate dehydrogenase (NAD + dependent), methenyltetra-hydrofolate cyclohydrolase | NM_006636 | NP_006627 | Hs.154672 | Mitochondrial | Folate metabolism |
| 103 | IL2RA | Interleukin 2 receptor, alpha | NM_000417 | NP_000408 | Hs.1724 | Membrane-bound and soluble forms | T cell mediated immune response |
| 77 | TNFSF6 | Tumor necrosis factor (ligand) superfamily, member 6 | NM_000639 | NP_000630 | Hs.2007 | Membrane-bound and soluble forms | CD8, CTL effector; proapoptotic |
| 115 | CD8B1 | CD8 antigen, beta polypeptide 1 (p37) | NM_004931 | NP_004922 | Hs.2299 | Membrane-bound and soluble forms | CTL mediated killing |
| 128 | PTGS2 | Prostaglandin-endoperoxide synthase 2 (prostaglandin G/H synthase and cyclooxygenase) | NM_000963 | NP_000954 | Hs.196384 | Membrane-associated | Angiogenesis, cell migration, synthesis of inflammatory prostaglandins |
| 89 | TAP1 | Transporter 1, ATP-binding cassette, sub-family B (MDR1/TAP) | NM_000593 | NP_000584 | Hs.352018 | ER membrane | Transports antigens into ER for association with MHC class I molecules |
| 92 | IGHM | Immunoglobulin heavy constant mu | BC032249 | | Hs.300697 | Cytoplasmic and secreted forms | Antibody subunit |
| 122 | GP1 | Glucose phosphate isomerase | NM_000175 | NP_000166 | Hs.409162 | Cytoplasmic and secreted forms | Glycolysis and gluconeogenesis (cytoplasmic); neurotrophic factor (secreted) |
| 2783 | GSN | Gelsolin (amyloidosis, Finnish type) | NM_000177 | NP_000168 | Hs.290070 | Cytoplasmic and secreted forms | Controls actin filament assembly/disassembly |
| 2780 | STK39 | Serine threonine kinase 39 (STE20/SPS1 homolog, yeast) | NM_013233 | NP_037365 | Hs.199263 | Cytoplasmic and nuclear | Mediator of stress-activated signals; Serine/Thr Kinase, activated p38 |
| 2770 | PSMB8 | Proteasome (prosome, macropain) subunit, beta type, 8 (large multifunctional protease 7) | AK092738 | | Hs.180062 | Cytoplasmic | Processing of MHC class I antigens |
| 2667 | LPXN | Leupaxin | NM_004811 | NP_004802 | Hs.49587 | Cytoplasmic | Signal transduction |
| 2669 | ITK | IL2-inducible T-cell kinase | L10717 | | Hs.211576 | Cytoplasmic | Intracellular kinase, T-cell proliferation and differentiation |

TABLE 9-continued

| Array Probe SEQ ID | Gene | Gene Name | mRNA Accession # | RefSeq Peptide Accession # | Current UniGene Cluster (Build 156) | Localization | Function |
|---|---|---|---|---|---|---|---|
| 90 | KPNA6 | Karyopherin alpha 6 (importin alpha | AW021037 | | Hs.301553 | Cytoplasmic | Nucleocytoplasmic transport |
| 2794 | SH2D2A | SH2 domain protein 2A | NM_003975 | NP_003966 | Hs.103527 | Cytoplasmic | CD8 T activation, signal transduction |
| 2765 | TNFSF5 | Tumor necrosis factor (ligand) superfamily, member 5 (hyper-IgM syndrome) | NM_000074 | NP_000065 | Hs.652 | Cellular membrane | B-cell proliferation, IgE production, immunoglobulin class switching; expressed on CD4 + and CD8 + T cells |
| 97 | CD69 | CD69 antigen (p60, early T-cell activation antigen) | NM_001781 | NP_001772 | Hs.82401 | Cellular membrane | Activation of lymphocytes, monocytes, and platelets |
| 2635 | IL2RG | Interleukin 2 receptor, gamma (severe combined immunodeficiency) | NM_000206 | NP_000197 | Hs.84 | Cellular membrane | Signalling component of many interleukin receptors (IL2, IL4, IL7, IL9, and IL15), |
| 96 | CXCR4 | Chemokine (C-X-C motif) receptor 4 | NM_003467 | NP_003458 | Hs.89414 | Cellular membrane | B-cell lymphopoiesis, leukocyte migration, angiogenesis; mediates intracellular calcium flux |
| 2766 | CD19 | CD19 antigen | NM_001770 | NP_001761 | Hs.96023 | Cellular membrane | Signal transduction; B lymphocyte development, activation, and differentiation |
| 2769 | ITGB1 | Integrin, beta 1 (fibronectin receptor, beta polypeptide, antigen CD29 includes MDF2, MSK12) | NM_002211 | NP_002202 | Hs.287797 | Cellular membrane | Cell-cell and cell-matrix interactions |
| 2647 | TRB | T cell receptor beta, constant region | K02885 | | Hs.300697 | Cellular membrane | Antigen recognition |
| 82 | CTLA4 | Cytotoxic T-lymphocyte-associated protein 4 | NM_005214 | NP_005205 | Hs.247824 | Cellular membrane | Negative regulation of T cell activation, expressed by activated T cells |
| 83 | CD8A | CD8 antigen, alpha polypeptide (p32) | NM_001768 | NP_001759 | Hs.85258 | Cellular membrane | CD8 T-cell specific marker and class I MHC receptor |
| 114 | HLA-DRB1 | Major histocompatibility complex, class II, DR beta 1 | NM_002124 | NP_002115 | Hs.308026 | Cellular membrane | Antigen presentation |
| 2772 | CD3Z | CD3Z antigen, zeta polypeptide (TiT3 complex) | NM_000734 | NP_000725 | Hs.97087 | Cellular membrane | T-cell marker; couples antigen recognition to several intracellular signal-transduction pathways |
| 2 | ACTB | Actin, beta | NM_001101 | NP_001092 | Hs.288061 | Cellular membrane | Cell adhesion and recognition |
| 2774 | ITGAL | Integrin, alpha L (antigen CD11A (p180), lymphocyte function-associated antigen 1; alpha polypeptide) | NM_002209 | NP_002200 | Hs.174103 | Cellular membrane | All leukocytes; cell-cell adhesion, signaling |
| 78 | TCIRG1 | T-cell, immune regulator 1, ATPase, H+ transporting, lysosomal V0 protein a isoform 3 | NM_006019 | NP_006010 | Hs.46465 | Cellular membrane | T cell activation |
| 2670 | CD72 | CD72 antigen | NM_001782 | NP_001773 | Hs.116481 | Cellular membrane | B cell proliferation |
| 2779 | D12S2489E | DNA segment on chromosome 12 (unique) 2489 expressed sequence | NM_007360 | NP_031386 | Hs.74085 | Cellular membrane | NK cells marker |

TABLE 9-continued

| Array Probe SEQ ID | Gene | Gene Name | mRNA Accession # | RefSeq Peptide Accession # | Current UniGene Cluster (Build 156) | Localization | Function |
|---|---|---|---|---|---|---|---|
| 2692 | MS4A1 | Membrane-spanning 4-domains, subfamily A, member 1, CD20 | NM_152866 | NP_690605 | Hs.89751 | Cellular membrane | B-cell activation, plasma cell development |
| 126 | TCRGC2 | T cell receptor gamma constant 2 | M17323 | | Hs.112259 | Cellular membrane | |
| 116 | CD4 | CD4 antigen (p55) | NM_000616 | NP_000607 | Hs.17483 | Cellular membrane | T cell activation, signal transduction, T-B cell adhesion |
| 117 | CXCR3 | Chemokine (C-X-C motif) receptor 3, GPR9 | NM_001504 | NP_001495 | Hs.198252 | Cellular membrane | Integrin activation, cytoskeletal changes and chemotactic migration of leukocytes |
| 2707 | CD33 | CD33 antigen (gp67) | NM_001772 | NP_001763 | Hs.83731 | Cellular membrane | Cell adhesion; receptor that inhibits the proliferation of normal and leukemic myeloid cells |
| 123 | CD47 | CD47 antigen (Rh-related antigen, integrin-associated signal transducer) | NM_001777 | NP_001768 | Hs.82685 | Cellular membrane | Cell adhesion, membrane transport, signaling transduction, permeability |
| 84 | BY55 | Natural killer cell receptor, immunoglobulin superfamily member | NM_007053 | NP_008984 | Hs.81743 | Cellular membrane | NK cells and CTLs, costim with MHC I |
| 2784 | KLRD1 | Killer cell lectin-like receptor subfamily D, member 1 | NM_002262 | NP_002253 | Hs.41682 | Cellular membrane | NK cell regulation |
| 124 | HLA-F | Major histocompatibility complex, class I, F | NM_018950 | NP_061823 | Hs.377850 | Cellular membrane | Antigen presentation |
| 2752 | PTPRCAP | Protein tyrosine phosphatase, receptor type, C-associated protein | NM_005608 | NP_006599 | Hs.155975 | Cellular membrane | T cell activation |

TABLE 12

Markers for CMV Infection

| New SEQID | Source | Unigene | Acc | GI | Name | Strand | Probe Sequence | SAM FDR |
|---|---|---|---|---|---|---|---|---|
| 408 | cDNA | Hs.1051 | NM_004131 | 7262379 | granzyme B | 1 | GGAGCCAAGTCCAGATT TACACTGGGAGAGGTGC CAGCAACTGAATAAAT | 0% |
| 3108 | db mining | Hs.169824 | NM_002258 | 4504878 | killer cell lectin-like receptor | 1 | TGGATCTGCCAAAAAGA ACTAACACCTGTGAGAA ATAAAGTGTATCCTGA | 0% |
| 3109 | cDNA | Hs.170019 | NM_004350 | 4757917 | runt-related transcription factor 3 | 1 | GCTGGGTGGAAACTGCT TTGCACTATCGTTTGCT TGGTGTTTGTTTTTAA | 0% |
| 433 | cDNA | Hs.183125 | NM_016523 | 7705573 | killer cell lectin-like receptor F | 1 | TTCCAGGCTTTTGCTAC TCTTCACTCAGCTACAA TAAACATCCTGAATGT | 0% |
| 3110 | db mining | Hs.2014 | X06557 | 37003 | T-cell receptor-delta | 1 | GGGGTTTATGTCCTAAC TGCTTTGTATGCTGTTT TATAAAGGGATAGAAG | 0.10% |
| 3111 | cDNA | Hs.211535 | AI823649 | 5444320 | EST IMAGE: 2400148 | -1 | GAAGCCTTTTCTTTTCT GTTCACCCTCACCAAGA GCACAACTTAAATAGG | 0.10% |
| 3112 | cDNA | Hs.301704 | AW002985 | 5849991 | eomesodermin (Xenopus laevis) | -1 | AACAAGCCATGTTTGCC CTAGTCCAGGATTGCCT CACTTGAGACTTGCTA | 0% |
| 3112 | Table 3B | Hs.301704 | AW002985 | 5849991 | eomesodermin (Xenopus laevis) | -1 | AACAAGCCATGTTTGCC CTAGTCCAGGATTGCCT CACTTGAGACTTGCTA | 0% |

TABLE 12-continued

Markers for CMV Infection

| New SEQID | Source | Unigene | Acc | GI | Name | Strand | Probe Sequence | SAM FDR |
|---|---|---|---|---|---|---|---|---|
| 3113 | cDNA | Hs.318885 | NM_000636 | 10835186 | superoxide dismutase 2 | 1 | TACTTTGGGGACTTGTA GGGATGCCTTTCTAGTC CTATTCTATTGCAGTT | 0.10% |
| 3114 | literature | Hs.41682 | NM_007334 | 7669498 | killer cell lectin-like receptor D | 1 | GGGCAGAGAAGGTGGAG AGTAAAGACCCAACATT ACTAACAATGATACAG | 0% |
| 3115 | cDNA | Hs.71245 | AI954499 | 5746809 | EST IMAGE: 502221 | −1 | TGGTAATAGTGTTTGAC TCCAGGGAAGAACAGAT GGGTGCCAGAGTGAAA | 0% |
| 3116 | cDNA | Hs.75596 | NM_000878 | 4504664 | interleukin 2 receptor, beta | 1 | ATGGAAATTGTATTTGC CTTCTCCACTTTGGGAG GCTCCCACTTCTTGGG | 0% |
| 436 | cDNA | Hs.75703 | NM_002984 | 4506844 | small inducible cytokine A4 | 1 | CCACTGTCACTGTTTCT CTGCTGTTGCAAATACA TGGATAACACATTTGA | 0% |
| 436 | cDNA | Hs.75703 | NM_002984 | 4506844 | small inducible cytokine A4 | 1 | CCACTGTCACTGTTTCT CTGCTGTTGCAAATACA TGGATAACACATTTGA | 0.10% |
| 436 | cDNA | Hs.75703 | NM_002984 | 4506844 | small inducible cytokine A4 | 1 | GTCCACTGTCACTGTTT CTCTGCTGTTGCAAATA CATGGATAACACATTT | 0% |
| 436 | cDNA | Hs.75703 | NM_002984 | 4506844 | small inducible cytokine A4 | −1 | TGGTCCACTGTCACTGT TTCTCTGCTGTTGCAAA TACATGGATAACACAT | 0.10% |
| 415 | cDNA | Hs.85258 | BC025715 | 19344021 | CD8 antigen | 1 | CTGAGAGCCCAAACTGC TGTCCCAAACATGCACT TCCTTGCTTAAGGTAT | 0.10% |
| 3117 | cDNA | Hs.111554 | AA806222 | 2874972 | cDNA 196D7 | −1 | TGATTTCTGTAATGTTT GACCTAATAATAGCCCT TTTCGTCTCTGACCCA | 0% |
| WBC | N/A | N/A | N/A | N/A | | N/A | N/A | 0.10% |
| WPT | N/A | N/A | N/A | N/A | | N/A | N/A | 0% |

SEQUENCE LISTING (3117 sequences)

SEQ ID NO: 1 - DNA, 50 bp, Homo sapiens
taaagtcaccgggcgctggaaatagagcctggcctccttcaccaaagatc

SEQ ID NO: 2 - DNA, 50 bp, Homo sapiens
ggaggcagccagggcttacctgtacactgacttgagaccagttgaataaa

SEQ ID NO: 3 - DNA, 50 bp, Homo sapiens
ctgggttttgtggtcatctattctagcagggaacactaaaggtggaaata

SEQ ID NO: 4 - DNA, 50 bp, Homo sapiens
aaagtaaggcatggttgtggttaatctggtttatttttgttccacaagtt

SEQ ID NO: 5 - DNA, 50 bp, Homo sapiens
agtttcataattgtgtactcggaaattaaagtttgcttgtttcttggtct

SEQ ID NO: 6 - DNA, 50 bp, Homo sapiens
tcgttaagagagcaacattttacccacacacagataaagttttcccttga

SEQ ID NO: 7 - DNA, 50 bp, Homo sapiens
tggtctgactgtgctatggcctcatcatcaagactttcaatcctatccca

SEQ ID NO: 8 - DNA, 50 bp, Homo sapiens
tgacccagatatggaaacagaagacaaaattgtaagccagagtcaacaaa

SEQ ID NO: 9 - DNA, 50 bp, Homo sapiens
gcttcacttgggtccaggcctactcctgtcttctgctttgttgtgtgcct

SEQ ID NO: 10 - DNA, 50 bp, Homo sapiens
tattaaggccctgttcattaagaaattgttcccttcccctgtgttcaatg

SEQ ID NO: 11 - DNA, 50 bp, Homo sapiens
cttcttttgccatgtttccattctgccatcttgaattgtcttgtcagcca

SEQ ID NO: 12 - DNA, 50 bp, Homo sapiens
ttttgaagagctttttctatattaggatatcagaattgttcaacttttca

SEQ ID NO: 13 - DNA, 50 bp, Homo sapiens
acgctaattaaattatgcaaaattaaatagttgtatgtagagaactgata

SEQ ID NO: 14 - DNA, 50 bp, Homo sapiens
gctcttaagttgtggagagtgcaacagtagcataggaccctaccctctgg

SEQ ID NO: 15 - DNA, 50 bp, Homo sapiens
ttcattaattcctcaacccaatactgtctggcttccaccaacaggagcgg

SEQ ID NO: 16 - DNA, 50 bp, Homo sapiens
ctaataagaaaattctaaatcaattattgaaacaggatacacacaattac

SEQ ID NO: 17 - DNA, 50 bp, Homo sapiens
atgggggtaataagagcagtagcagcagcatctctgaacatttctctgga

SEQ ID NO: 18 - DNA, 50 bp, Homo sapiens
atgggagtaataagagcagtggcagcagcatctctgaacatttctctgga

SEQ ID NO: 19 - DNA, 50 bp, Homo sapiens
gagaagacagtggcgaccaagacgattttctgccttagagcaagggattc

SEQ ID NO: 20 - DNA, 50 bp, Homo sapiens
gcaattcctcaggctaagctgccggttcttaaatccatcctgctaagtta

SEQ ID NO: 21 - DNA, 50 bp, Homo sapiens
caagacactgtggacttggtcaccagctcctcccttgttctctaagttcc

SEQ ID NO: 22 - DNA, 50 bp, Homo sapiens
ctccccgtgagcactgcgtacaaacatccaaaagttcaacaacaccagaa

SEQ ID NO: 23 - DNA, 50 bp, Homo sapiens
tgaaatatcagactagtgacaagctcctggtcttgagatgtcttctcgtt

SEQ ID NO: 24 - DNA, 50 bp, Homo sapiens
ctgctgtcttcacccgaatctcccattaccggccctggatcaaccagatc

SEQ ID NO: 25 - DNA, 50 bp, Homo sapiens
tgtgtaaatacataagcggcgtaagtttaaaggatgttggtgttccacgt

SEQ ID NO: 26 - DNA, 50 bp, Homo sapiens
ctgatcttactctactgctgctgacataaaaccaggaccctttctccaca

SEQ ID NO: 27 - DNA, 50 bp, Homo sapiens
tgtgagagatgccccacaccaaacccaaccctcccgatggctgcattccc

SEQ ID NO: 28 - DNA, 50 bp, Homo sapiens
tctctcaggagcaggggcattgctgattttgtctgcccaatccatcctgc

SEQ ID NO: 29 - DNA, 50 bp, Homo sapiens
cgtggatgagctggagttccgcaagaaacggagccagaggcccagcaggt

SEQ ID NO: 30 - DNA, 50 bp, Homo sapiens
atgagggcacagagcatggcctccagaggaggggtggtgtccttctcctc

SEQ ID NO: 31 - DNA, 50 bp, Homo sapiens
ctttgggttggagctgttccattgggtcctcttggtgtcgtttccctccc

SEQ ID NO: 32 - DNA, 50 bp, Homo sapiens
gatccagaatccactctccagtctccctcccctgactccctctgctgtcc

SEQ ID NO: 33 - DNA, 50 bp, Homo sapiens
attatgactatcaagggagcagtttaaataaccgtttcctttcatttact

SEQ ID NO: 34 - DNA, 50 bp, Homo sapiens
ctccaaataccgttaagctggagcctcggtggccatgcttcttgcccctt

SEQ ID NO: 35 - DNA, 50 bp, Homo sapiens
cgtatcctctgtcctgaccgagaagtaccgctgagcgccgcctccgggac

SEQ ID NO: 36 - DNA, 50 bp, Homo sapiens
aagtccaactactaaactgggggatattatgaagggccttgagcatctgg

SEQ ID NO: 37 - DNA, 50 bp, Homo sapiens
ttctgaacttgggaacacaatgcctacttcaagggtatggcttctgccta

SEQ ID NO: 38 - DNA, 50 bp, Homo sapiens
atggggactgggcttggccttgagagaaagccttctgtttaataaagtac

SEQ ID NO: 39 - DNA, 50 bp, Homo sapiens
cactgcccatgattcagagctttcaaggataggctttattctgcaagcaa

SEQ ID NO: 40 - DNA, 50 bp, Homo sapiens
ggatccccaggcgaccttccccgtgtttgagtaaagcctctcccaggagc

SEQ ID NO: 41 - DNA, 50 bp, Homo sapiens
ccctcactgtcaccttcccgagaataccctaagaccaataaatacttcag

SEQ ID NO: 42 - DNA, 50 bp, Homo sapiens
agccgcccagctacctaattcctcagtaacatcgatctaaaatctccatg

SEQ ID NO: 43 - DNA, 50 bp, Homo sapiens
cagaccctggtgatgctggaaacagttcctcggagtggagaggtttacac

SEQ ID NO: 44 - DNA, 50 bp, Homo sapiens
gcctcgacacatcctcatccccagcatgggacacctcaagatgaataata

SEQ ID NO: 45 - DNA, 50 bp, Homo sapiens
tgacatcatattctttcagagaagtgtcccaggacatgataataagatgc

SEQ ID NO: 46 - DNA, 50 bp, Homo sapiens
agtggggtggggagcatgttcatttgtacctcgagttttaaactggttcc

SEQ ID NO: 47 - DNA, 50 bp, Homo sapiens
agctgttcccaaattttctaacgagtggaccattatcactttaaagccct

SEQ ID NO: 48 - DNA, 50 bp, Homo sapiens
ctccgggagaggggacggtcaatcctgtgggtgaagacagagggaaacac

SEQ ID NO: 49 - DNA, 50 bp, Homo sapiens
gcaaccttgcatccatctgggctaccccacccaagtatacaataaagtct

SEQ ID NO: 50 - DNA, 50 bp, Homo sapiens
gactgacgcaacccacgtgtaactgtcagccgggccctgagtaatcgctt

SEQ ID NO: 51 - DNA, 50 bp, Homo sapiens
ggtctttagcctccaccttgtctaagctttggtctataaagtgcgctaca

SEQ ID NO: 52 - DNA, 50 bp, Homo sapiens
caccagcatccaggcggccagcaggcacctgagtggctgggacaagggat

SEQ ID NO: 53 - DNA, 50 bp, Homo sapiens
caactgatagccacgctgaagaatggaaggaaaatttgcttggacctgca

SEQ ID NO: 54 - DNA, 50 bp, Homo sapiens
cagccctggataggtttttatgggaattctttacaataaacatagcttgt

SEQ ID NO: 55 - DNA, 50 bp, Homo sapiens
ttctacatgtattgttgtggttttattcattgtatgaaaattcctgtgat

SEQ ID NO: 56 - DNA, 50 bp, Homo sapiens
accaggatgcaatggatttatttgattcaggggacctgtatttccatgtc

SEQ ID NO: 57 - DNA, 50 bp, Homo sapiens
cctgtgtgggactgagatgcaggatttcttcacacctctcctttgtgact

SEQ ID NO: 58 - DNA, 50 bp, Homo sapiens
cccagataatgtgaaaatggtccaggagaaggccaattcctatacgcagc

SEQ ID NO: 59 - DNA, 50 bp, Homo sapiens
ctgcaccgttctaggtgccgatggctgcctccggctctctgcttacgtat

SEQ ID NO: 60 - DNA, 50 bp, Homo sapiens
ccaatcccgatccaaatcataatttgttcttaagtatactgggcaggtcc

SEQ ID NO: 61 - DNA, 50 bp, Homo sapiens
gtcactggaggaccaacccctgctgtccaaaacaccactgcttcctaccc

SEQ ID NO: 62 - DNA, 50 bp, Homo sapiens
tgggcatggttgaatctgaaaccctccttctgtggcaacttgtactgaaa

SEQ ID NO: 63 - DNA, 50 bp, Homo sapiens
tgaatataagcaatgaagatgaacatttattgatcttctacatacaagac

SEQ ID NO: 64 - DNA, 50 bp, Homo sapiens
cctccaaccccggaaacttcctgtgcaacccagactatcacctttgaaag

SEQ ID NO: 65 - DNA, 50 bp, Homo sapiens
aggccttgtttttcagcttcatctgcagttctatgtgaagattgataaat

SEQ ID NO: 66 - DNA, 50 bp, Homo sapiens
gtggggctgtgaattctttcttcatccccgcattcccaatatacccaggc

SEQ ID NO: 67 - DNA, 50 bp, Homo sapiens
gttttaaaataatatgtaaatttttcagctatttagtgatatattttatg

SEQ ID NO: 68 - DNA, 50 bp, Homo sapiens
tttccttctctctcaattttcggttgaataaactagattacattcagttg

SEQ ID NO: 69 - DNA, 50 bp, Homo sapiens
ctccctcacagcacagagaagacaaaattagcaaaaccccactacacagt

SEQ ID NO: 70 - DNA, 50 bp, Homo sapiens
tgctttttcgcgctctgaccacctggccttgcacatgaagcgccaccttt

SEQ ID NO: 71 - DNA, 50 bp, Homo sapiens
catttcctgagaccaccagagagaggggagaagcctgggattgacagaag

SEQ ID NO: 72 - DNA, 50 bp, Homo sapiens
agtgggattttatgccagttgttaaaatgagcattgatgtacccattttt

SEQ ID NO: 73 - DNA, 50 bp, Homo sapiens
ctgcccatctcagcctcaccatcaccctgctaatgactgccagactgtgg

SEQ ID NO: 74 - DNA, 50 bp, Homo sapiens
gcaataccaagagaaaatgcacaaatatcactggatggagatgtcacatt

SEQ ID NO: 75 - DNA, 50 bp, Homo sapiens
agctgtgttggtagtgctgtgttgaattacggaataatgagttagaacta

SEQ ID NO: 76 - DNA, 50 bp, Homo sapiens
ggagccaagtccagatttacactgggagaggtgccagcaactgaataaat

SEQ ID NO: 77 - DNA, 50 bp, Homo sapiens
ccatcggtgaaactaacagataagcaagagagatgttttggggactcatt

SEQ ID NO: 78 - DNA, 50 bp, Homo sapiens
tgccagacctccttcctgacctctgaggcaggagaggaataaagacggtc

SEQ ID NO: 79 - DNA, 50 bp, Homo sapiens
cctgtgatcaggctcccaagtctggttcccatgaggtgagatgcaacctg

SEQ ID NO: 80 - DNA, 50 bp, Homo sapiens
accagagtacgttggaaaacttcttggaaaggctaaagacgatcatgaga

SEQ ID NO: 81 - DNA, 50 bp, Homo sapiens
ggggaggggacattgaacaagttgtttcattgactatcaaactgaagcca

SEQ ID NO: 82 - DNA, 50 bp, Homo sapiens
gggtctatgtgaaaatgcccccaacagagccagaatgtgaaaagcaattt

SEQ ID NO: 83 - DNA, 50 bp, Homo sapiens
ctgagagcccaaactgctgtcccaaacatgcacttccttgcttaaggtat

SEQ ID NO: 84 - DNA, 50 bp, Homo sapiens
cagaccaagagcaccacagactacaactgcccagcttcatctaaatactt

SEQ ID NO: 85 - DNA, 50 bp, Homo sapiens
gcaaaaagcccaagagcctgaatttagaccaatctatcatcttcctcctc

SEQ ID NO: 86 - DNA, 50 bp, Homo sapiens; identical to SEQ ID NO: 36

SEQ ID NO: 87 - DNA, 50 bp, Homo sapiens
ttcctctttggccacaagaataagcagcaaataaacaactatggctgttg

SEQ ID NO: 88 - DNA, 50 bp, Homo sapiens
tgggcagcttgggtaagtacgcaacttacttttccaccaaagaactgtca

SEQ ID NO: 89 - DNA, 50 bp, Homo sapiens
gctggcccataaacaccctgtaggttcttgatatttataataaaattggt

SEQ ID NO: 90 - DNA, 50 bp, Homo sapiens
acataggcgaagaaaacatggcattgagtgtgctgagtccagacaaatgt

SEQ ID NO: 91 - DNA, 50 bp, Homo sapiens
ccggcagctgtgtttagcccctccagatggaagtttcacttgaatgtaaa

SEQ ID NO: 92 - DNA, 50 bp, Homo sapiens
gtcaatgtgtctgttgtcatggcggaggtggacggcacctgctactgagc

SEQ ID NO: 93 - DNA, 50 bp, Homo sapiens
agctcatatgaacactgctctgaactcctctgacttagcattcaacttaa

SEQ ID NO: 94 - DNA, 50 bp, Homo sapiens
tttgtactattgctagaccctcttctgtaatgggtaatgcgtttgattgt

SEQ ID NO: 95 - DNA, 50 bp, Homo sapiens
aggacttctctggggactttcgaatgttgccatgtaaatctttgagacca

SEQ ID NO: 96 - DNA, 50 bp, Homo sapiens
tcagttttcaggagtgggttgatttcagcacctacagtgtacagtcttgt

SEQ ID NO: 97 - DNA, 50 bp, Homo sapiens
gcaagacatagaatagtgttggaaaatgtgcaatatgtgatgtggcaaat

SEQ ID NO: 98 - DNA, 50 bp, Homo sapiens
agcttccgccgtctcaacccctcacaggagcttactggcaaacatgaaaa

SEQ ID NO: 99 - DNA, 50 bp, Homo sapiens
gcagtttgaatatcctttgtttcagagccagatcatttcttggaaagtgt

SEQ ID NO: 100 - DNA, 50 bp, Homo sapiens
gttctggaactaaagggatctgaaacaacattcatgtgtgaatatgcaga

SEQ ID NO: 101 - DNA, 50 bp, Homo sapiens
ttccaggcttttgctactcttcactcagctacaataaacatcctgaatgt

SEQ ID NO: 102 - DNA, 50 bp, Homo sapiens
aaccggatatatacatagcatgacatttctttgtgctttggcttacttgt

SEQ ID NO: 103 - DNA, 50 bp, Homo sapiens
actaatttgatgtttacaggtggacacacaaggtgcaaatcaatgcgtac

SEQ ID NO: 104 - DNA, 50 bp, Homo sapiens
gtccactgtcactgtttctctgctgttgcaaatacatggataacacattt

SEQ ID NO: 105 - DNA, 50 bp, Homo sapiens
aaattcaaatcacccttgatacccacttctttctcccacccaaatctgat

SEQ ID NO: 106 - DNA, 50 bp, Homo sapiens
agctaattatctctttgagtccttgcttctgtttgctcacagtaagctca

SEQ ID NO: 107 - DNA, 50 bp, Homo sapiens
tgctgctacagttgcaaaacactggagctagagaaaataaagtactgatc

SEQ ID NO: 108 - DNA, 50 bp, Homo sapiens
tgacccacttaccttgcatctcacaggtagacagtatataactaacaacc

SEQ ID NO: 109 - DNA, 50 bp, Homo sapiens
cccaaattctttcagtggctacctacatacaattccaaacacatacagga

SEQ ID NO: 110 - DNA, 50 bp, Homo sapiens
atcaacagaccaacatttttctcttcctcaagcaacactcctagggcctg

SEQ ID NO: 111 - DNA, 50 bp, Homo sapiens
atgtgctgtcaaaacaagtttttctgtcaagaagatgatcagaccttgga

SEQ ID NO: 112 - DNA, 50 bp, Homo sapiens
tcaattcctctgggaatgttacattgtttgtctgtcttcatagcagattt

SEQ ID NO: 113 - DNA, 50 bp, Homo sapiens
atgcctggtgcttccaaatattgttgacaactgtgactgtacccaaatgg

SEQ ID NO: 114 - DNA, 50 bp, Homo sapiens
cttgtggcttcctcagctcctgcccttggcctgaagtcccagcattgatg

SEQ ID NO: 115 - DNA, 50 bp, Homo sapiens
aagtttctcagctcccatttctactctcccatggcttcatgcttctttca

SEQ ID NO: 116 - DNA, 50 bp, Homo sapiens
tttccttcaagcctagcccttctctcattatttctctctgaccctctccc

SEQ ID NO: 117 - DNA, 50 bp, Homo sapiens
aaactaaaacttcatcttccccaagtgcggggagtacaaggcatggcgta

SEQ ID NO: 118 - DNA, 50 bp, Homo sapiens
ccccctcgaccccctcacaccctttccagagaggccttaagattcccatt

SEQ ID NO: 119 - DNA, 50 bp, Homo sapiens
gactccctcaacaccccaaaactctaaatgccacggtcatctgtttctat

SEQ ID NO: 120 - DNA, 50 bp, Homo sapiens
tgtttaatggtagttttacagtgtttctggcttagaacaaaggggcttaa

SEQ ID NO: 121 - DNA, 50 bp, Homo sapiens
atcagaaaccgaagattaactacacagctccagaagactcagacctcaaa

SEQ ID NO: 122 - DNA, 50 bp, Homo sapiens
tgttcacgttgttcacatcccatgtagaaaaacaaagatgccacggagga

SEQ ID NO: 123 - DNA, 50 bp, Homo sapiens
aaagtaactggttgtcacctatgagacccttacgtgattgttagttaagt

SEQ ID NO: 124 - DNA, 50 bp, Homo sapiens
ggactgagaagcaagatatcaatgtagcagaattgcacttgtgcctcacg

SEQ ID NO: 125 - DNA, 50 bp, Homo sapiens
acagttactttggagctgctagactggttttctgtgttggtaaattgcct

SEQ ID NO: 126 - DNA, 50 bp, Homo sapiens
tttacacgccctgaagcagtcttctttgctagttgaattatgtggtgtgt

SEQ ID NO: 127 - DNA, 50 bp, Homo sapiens
gtccagagctagaagaaccaagtcttcctttcttcattcattgttcaggt

SEQ ID NO: 128 - DNA, 50 bp, Homo sapiens
gctgacaaaacctgggaatttgggttgtgtatgcgaatgtttcagtgcct

SEQ ID NO: 129 - DNA, 50 bp, Homo sapiens
cctgccagggttgttcggaagtcgcaggtccgaaaatctcctccgcatac

SEQ ID NO: 130 - DNA, 50 bp, Homo sapiens
cctcccagcaacccactacctctggtacctgtaaaggtcaaacaagaaac

SEQ ID NO: 131 - DNA, 50 bp, Homo sapiens
cctcaattttattctaatcattcccactcagtacccgccacccccacccc

SEQ ID NO: 132 - DNA, 50 bp, Homo sapiens
cgacccttagccttgctgtagagacttccgtcacccttggtagagtttat

SEQ ID NO: 133 - DNA, 50 bp, Homo sapiens
agaggaaaactgctgctcaaaaagacagtctcacctttgcacctgtttct

SEQ ID NO: 134 - DNA, 50 bp, Homo sapiens; identical to SEQ ID NO: 9

SEQ ID NO: 135 - DNA, 50 bp, Homo sapiens
acctgtcacgcttctagttgcttcaaccattttataaccatttttgtaca

SEQ ID NO: 136 - DNA, 50 bp, Homo sapiens
caggaggatggcaaagagagtcgcatctcagtgcaggagagacagtgagg

SEQ ID NO: 137 - DNA, 50 bp, Homo sapiens
gctgcgaaagacccacatgctacaagacgggcaaaataaagtgacagatg

SEQ ID NO: 138 - DNA, 50 bp, Homo sapiens
ggccaagcccagcttaatggctcatgacctggaaataaaatttaggacca

SEQ ID NO: 139 - DNA, 50 bp, Homo sapiens; identical to SEQ ID NO: 8

SEQ ID NO: 140 - DNA, 50 bp, Homo sapiens
ttgggattgggcataaacaggcccactgggaaatagtagctgtactgcat

SEQ ID NO: 141 - DNA, 50 bp, Homo sapiens
ttctacggactcgtctgggttcttggccccctctggtaggactgggcgac

SEQ ID NO: 142 - DNA, 50 bp, Homo sapiens
ggagggatatcaggtcatcattgtgtatcaaaagatgatttgtacaacag

SEQ ID NO: 143 - DNA, 50 bp, Homo sapiens
aggaaccagcaagtcaacaaaagactaacaaagaaaaaccatcttggaat

SEQ ID NO: 144 - DNA, 50 bp, Homo sapiens
cgagttctgccaggacatctttctcggggttctcgttgcaatcctcggtc

SEQ ID NO: 145 - DNA, 50 bp, Homo sapiens
tcacatcatgcagctccttaatacaagccatccacatctcccgcttatcc

SEQ ID NO: 146 - DNA, 50 bp, Homo sapiens
gcctccacacgacatcacaccatataccgcaaggaatatcagggatgctg

SEQ ID NO: 147 - DNA, 50 bp, Homo sapiens
gagaagcacctcaacctggagacaattctactgttcaaacagcagcagca

SEQ ID NO: 148 - DNA, 50 bp, Homo sapiens; identical to SEQ ID NO: 141

SEQ ID NO: 149 - DNA, 50 bp, Homo sapiens
gtgaaggccctggaccaacccggcccgggccccccggtatcgggccagag

SEQ ID NO: 150 - DNA, 50 bp, Homo sapiens
tggcgcctttaatatgatgggaggatgtttgcagaatgccttagatatct

SEQ ID NO: 151 - DNA, 50 bp, Homo sapiens; identical to SEQ ID NO: 144

SEQ ID NO: 152 - DNA, 50 bp, Homo sapiens
ttgaccatagaatcaagcctgaggctgtgaagatggtgcaagtgtggaga

SEQ ID NO: 153 - DNA, 50 bp, Homo sapiens
aaaattagtggattgactccactttgttgtgttgttttcattgttgaaaa

SEQ ID NO: 154 - DNA, 50 bp, Homo sapiens
gaggtgtctccatctctgcctcaacttcatggtgcactgagctgtaactt

SEQ ID NO: 155 - DNA, 50 bp, Homo sapiens
caaccttcttgttgaattgatttactactcatcagggtcatgcacaagca

SEQ ID NO: 156 - DNA, 50 bp, Homo sapiens
caggtcaacccccaccggacctacaacccgcagtcccacatcatctcagg

SEQ ID NO: 157 - DNA, 50 bp, Homo sapiens
acccgtgtgaatgtgaagaaaagcagtatgttactggttgttgttgttgt

SEQ ID NO: 158 - DNA, 50 bp, Homo sapiens
tttagggttgtgactggctttggtgcaaatgtgtgctcaagctaataagt

SEQ ID NO: 159 - DNA, 50 bp, Homo sapiens
tgcagtgagactacatttctgtctaaagaagatgtgtgagttccgtcctt

SEQ ID NO: 160 - DNA, 50 bp, Homo sapiens
catatgggagaaggccagtgcccaggcatagggttagctcagtttccctc

SEQ ID NO: 161 - DNA, 50 bp, Homo sapiens
ctgggctgtaggtactgctgggtcactgttgctataaatggtcactggag

SEQ ID NO: 162 - DNA, 50 bp, Homo sapiens
tggtccaaaggcaaagttcgggacaagctcaataacttagtcttgtttga

SEQ ID NO: 163 - DNA, 50 bp, Homo sapiens
ctagggagccgcaccttatcatgtaccatcaataaagtaccctgtgctca

SEQ ID NO: 164 - DNA, 50 bp, Homo sapiens
gcaaagaaagaagaatccgaggagtctgatgatgacatgggctttggtct

SEQ ID NO: 165 - DNA, 50 bp, Homo sapiens
ttttggaacccttagccctgtgcaaatcaaaggatgtgaggggaaaaagg

SEQ ID NO: 166 - DNA, 50 bp, Homo sapiens
tttaagggagtcaggaatagatgtatgaacagtcgtgtcactggatgcct

SEQ ID NO: 167 - DNA, 50 bp, Homo sapiens
tcctaatttcttctgtgaaccttctcaaatcccccagcatgcgtgtagtg

SEQ ID NO: 168 - DNA, 50 bp, Homo sapiens
tgacctccaccaaagcccatataaggagcggagttgttaaggactgaaga

SEQ ID NO: 169 - DNA, 50 bp, Homo sapiens
tcaagaatttgggtgggagaaaagaaagtgggttatcaagggtgatttga

SEQ ID NO: 170 - DNA, 51 bp, Homo sapiens
gcaactgttttctaggacatgtttactagaactactttaagtatgctgtgc

SEQ ID NO: 171 - DNA, 50 bp, Homo sapiens
ttctctgcatctaggccatcatactgccaggctggttatgactcagaaga

SEQ ID NO: 172 - DNA, 50 bp, Homo sapiens
ctcaacgaaaggctcacactaacaggggaggattacagcaccacaatact

SEQ ID NO: 173 - DNA, 50 bp, Homo sapiens
tggggtaagtggagttgggaaatacaagaagagaaagaccagtggggatt

SEQ ID NO: 174 - DNA, 50 bp, Homo sapiens
aggaggaactggggaaggtggtcattcaggggaagaaccaggatgcaggg

SEQ ID NO: 175 - DNA, 50 bp, Homo sapiens
tgaacctcagcccattaggcaggaaaagttgatatttaataaacaaggaa

SEQ ID NO: 176 - DNA, 50 bp, Homo sapiens
gtgatcaaacaaattcacagcacagacaccgcgcaacaacgcaacttctc

SEQ ID NO: 177 - DNA, 50 bp, Homo sapiens
cccacgggagactatttcacacaatttaatacaggaagtcgataatgagg

SEQ ID NO: 178 - DNA, 50 bp, Homo sapiens
tgactgaaggcaagctcacagatgaagcagaggactgaagatctcgatct

SEQ ID NO: 179 - DNA, 50 bp, Homo sapiens
gggaaaaacaagaatttcatgactctacctgtggtctatctttaatttca

SEQ ID NO: 180 - DNA, 50 bp, Homo sapiens
agagaacaacaaaaccaccacgacgatgaaacaaaacgctcaaccaaaca

SEQ ID NO: 181 - DNA, 50 bp, Homo sapiens
gtggagctgttggccttgctggatgcgggcactctctacaccttcaggta

SEQ ID NO: 182 - DNA, 50 bp, Homo sapiens
gggttcaatcccttcagctcaggcggaccatttagatttaaattccactt

SEQ ID NO: 183 - DNA, 50 bp, Homo sapiens
ttccacagataggtaagccaggcgcggcaagatgagactgtattcagtta

SEQ ID NO: 184 - DNA, 50 bp, Homo sapiens
cccaccttccacctcttagcactggtgaccccaaaaatgaaaccatcaat

SEQ ID NO: 185 - DNA, 50 bp, Homo sapiens
tgcctttaattgttctcataatgaagaataagtaggtaccctccatgccc

SEQ ID NO: 186 - DNA, 50 bp, Homo sapiens
gctagatccccggtggttttgtgctcaaaataaaaagcctcagtgaccca

SEQ ID NO: 187 - DNA, 50 bp, Homo sapiens
acccaaaggatggtgtctcctgtcccagttgaaaaggtttctacctagct

SEQ ID NO: 188 - DNA, 50 bp, Homo sapiens
aataatagattagcagaaggaataatccgtgcgaccgagcttgtgcttct

SEQ ID NO: 189 - DNA, 50 bp, Homo sapiens
gaacatcaggagaggagtccagagcccacgtctactgcggaaaagtcagg

SEQ ID NO: 190 - DNA, 50 bp, Homo sapiens
tcccacttcaagttaagcaccaaagcaatcactaattctggagcacagga

SEQ ID NO: 191 - DNA, 50 bp, Homo sapiens
ttcgtgggcaccaagtttcgcaagaactacactgtctgctggccgagttt

SEQ ID NO: 192 - DNA, 50 bp, Homo sapiens
agcctggaattctaagcagcagtttcacaatctgtaattgcacgtttctg

SEQ ID NO: 193 - DNA, 50 bp, Homo sapiens
aacagaaacagctatggcaacagcatcaccctcagagcatcaccaacttg

SEQ ID NO: 194 - DNA, 50 bp, Homo sapiens
agcacaagccacgcttcaccaccaagaggcccaacaccttcttctaggtg

SEQ ID NO: 195 - DNA, 50 bp, Homo sapiens
ggaccattccggagcagccccacatacctcactgtctcgtctgtctatgt

SEQ ID NO: 196 - DNA, 50 bp, Homo sapiens
cagagaacgaaagtcaagtgcagcgagttgggtggaagctgatagagcaa

SEQ ID NO: 197 - DNA, 50 bp, Homo sapiens
agttggactaaatgctcttccttcagaggattatccggggcatctactca

SEQ ID NO: 198 - DNA, 50 bp, Homo sapiens
ctggcacatccaggttttagagcaggcagcctgagatttcaaaaatgagg

SEQ ID NO: 199 - DNA, 50 bp, Homo sapiens
catcttctccaccaaccagggtgggttcatgctgcctatctacgagacgg

SEQ ID NO: 200 - DNA, 50 bp, Homo sapiens
gctgtgcccttgaagagaatagtaatgatgggaatttagaggtttatgac

SEQ ID NO: 201 - DNA, 50 bp, Homo sapiens
actaattcccgtgtctggccctgaacatgaagatataatggacgatccct

SEQ ID NO: 202 - DNA, 50 bp, Homo sapiens
taaaatatgccctaatttaaagggcgcagggtcccacaacaagccacaga

SEQ ID NO: 203 - DNA, 50 bp, Homo sapiens
cagaactccatagacagcctcactttgtgctcgggggcctgtcccaaggc

SEQ ID NO: 204 - DNA, 50 bp, Homo sapiens
acacaagatactgccactttctctacacaaagacccacccaaacaccagc

SEQ ID NO: 205 - DNA, 50 bp, Homo sapiens
tgcatcgtaaaaccttcagaaggaaaggagaatgttttgtggaccacttt

SEQ ID NO: 206 - DNA, 50 bp, Homo sapiens
ctgaatttggttttgggaggtgaggcttcccaaccacggaagactacttt

SEQ ID NO: 207 - DNA, 50 bp, Homo sapiens
tagggagccgcaccttgtcatgtaccatcaataaagtaccctgtgctcaa

SEQ ID NO: 208 - DNA, 50 bp, Homo sapiens
ttaataccaggaacccagcggctctagccactgagcggctaaatgaaata

SEQ ID NO: 209 - DNA, 50 bp, Homo sapiens
gcagagttcattgttgccccttaacagtttttcctgagtttactgaagaa

SEQ ID NO: 210 - DNA, 50 bp, Homo sapiens
actcgctcagaagagggaactaagcatttttggcaaccaatgggcagata

SEQ ID NO: 211 - DNA, 50 bp, Homo sapiens
aatggaggcacgaacgcaggggccaaatagcaataaatgggttttgtttt

SEQ ID NO: 212 - DNA, 50 bp, Homo sapiens
tctcgactgacacccactataaattccctgggttgaaaaacttttctttt

SEQ ID NO: 213 - DNA, 50 bp, Homo sapiens
gaaatgagttggtgtcttcacagaatgaggatccccagagccatcttgcc

SEQ ID NO: 214 - DNA, 50 bp, Homo sapiens
cctgttgtggctggctgcataataatttccaggaggctttcggaaatgtt

SEQ ID NO: 215 - DNA, 50 bp, Homo sapiens
gttaacttccaggagttcctcattctggtgataaagatgggctggcagcc

SEQ ID NO: 216 - DNA, 50 bp, Homo sapiens
tctggctctgaccggttgatggccttgagcgaatgaaatcatgaaattga

SEQ ID NO: 217 - DNA, 50 bp, Homo sapiens
tgtaatgaatttgtcgcaaagacgtaataaaattaactggtggcacggtc

SEQ ID NO: 218 - DNA, 50 bp, Homo sapiens
aaggatgttccttcaggaggaagcagcactaaaagcactctgagtcaaga

SEQ ID NO: 219 - DNA, 50 bp, Homo sapiens
tgccacagtagccctagtgtttaagtgttgcctctcaaacttgtcctctt

SEQ ID NO: 220 - DNA, 50 bp, Homo sapiens
ttctgacacgattacacaacgaggctttaatgccatttgggtaggtgagc

SEQ ID NO: 221 - DNA, 50 bp, Homo sapiens
atgcgtcctggttttcaatcgctgctgaacaaacctatcaaaaatgtagc

SEQ ID NO: 222 - DNA, 50 bp, Homo sapiens
aacagttgggcaccctgaatggcaaatggcaaatttggagcgctaataat

SEQ ID NO: 223 - DNA, 50 bp, Homo sapiens
agttttaataccttaagctttttcaagacctaactgcagccgctttggga

SEQ ID NO: 224 - DNA, 50 bp, Homo sapiens
catctcatgcgtagcactgatcaatgtgccccagggtgtgtattcgccac

SEQ ID NO: 225 - DNA, 50 bp, Homo sapiens
tggatagttgctcaatgtagcagtgatgttcttggaattgccagcagagc

SEQ ID NO: 226 - DNA, 50 bp, Homo sapiens
tcaggttgaagtcaagatgacagataaggtgagagtaatgactactccaa

SEQ ID NO: 227 - DNA, 50 bp, Homo sapiens
cttaactgagggcttgtcctggttataaatgtctgggtgggggtgggcac

SEQ ID NO: 228 - DNA, 50 bp, Homo sapiens
aaaggaagaagcacgatgcaaacagaaacaagacgagacagagtgagcga

SEQ ID NO: 229 - DNA, 50 bp, Homo sapiens
cagtccctctcccaggaggaccctagaggcaattaaatgatgtcctgttc

SEQ ID NO: 230 - DNA, 50 bp, Homo sapiens
cggacggaaggacggaaaaagctctatttttatgttaggcttatttcatg

SEQ ID NO: 231 - DNA, 50 bp, Homo sapiens
gctttgcctctcggaggagtcaaaggggcagtaactgtatggggtgagag

SEQ ID NO: 232 - DNA, 50 bp, Homo sapiens
gctcaagttcccagcacctggggaattctaagcctgaggaagacaaggtg

SEQ ID NO: 233 - DNA, 50 bp, Homo sapiens
acacggaagtgaagattcctgaggatctaacttgcagttggacactatgt

SEQ ID NO: 234 - DNA, 50 bp, Homo sapiens
acccaccacctcttgcactctcgcttttggagcaagttgcattaactatt

SEQ ID NO: 235 - DNA, 50 bp, Homo sapiens
ggatcacttgaagccagcagtttgagaccagcctgggcaataaaatgaga

SEQ ID NO: 236 - DNA, 50 bp, Homo sapiens
ccactgagaactaaatgctgtaccacagagccgggtgtgaactatggttt

SEQ ID NO: 237 - DNA, 50 bp, Homo sapiens
agaaagttaggagtcggcaaccttaaggaggagtttcctatcatctctcc

SEQ ID NO: 238 - DNA, 50 bp, Homo sapiens
ctgtagagagtcttcaagatcccggagtggtagcgctgtctcctggtgaa

SEQ ID NO: 239 - DNA, 50 bp, Homo sapiens
cggccaacccaggagggcaggtgttttgggcatctggtttatagtacctc

SEQ ID NO: 240 - DNA, 50 bp, Homo sapiens
ggggaaggagggtgattatattgctttgtaatggtttgtgatacttgaaa

SEQ ID NO: 241 - DNA, 50 bp, Homo sapiens
cgcttaagaacattgcctctgggtgtcatgtggaccagacttctgaatag

SEQ ID NO: 242 - DNA, 50 bp, Homo sapiens
agtgctgtattgactttgctcggcagtagatgaagctattctgaacccaa

SEQ ID NO: 243 - DNA, 50 bp, Homo sapiens
aaagattgttggttaggccagattgacacctatttataaaccatatgcgt

SEQ ID NO: 244 - DNA, 50 bp, Homo sapiens
tctctgctcaatctctgcttggctccaaggacctgggatctcctggtacg

SEQ ID NO: 245 - DNA, 50 bp, Homo sapiens
gtacacccctcaaccctatgcagcctggagtgggcatcaataaaatgaac

SEQ ID NO: 246 - DNA, 50 bp, Homo sapiens
tgcgaaattgtggactgttggactgtgattctaagtgggggaaataggct

SEQ ID NO: 247 - DNA, 50 bp, Homo sapiens
catatgcggctgtgccatagccggatgttcttcgtgcgtgcctacccccg

SEQ ID NO: 248 - DNA, 50 bp, Homo sapiens
ctctgccctcctgtcacccagtagagtaaataaacttccttggctcctaa

SEQ ID NO: 249 - DNA, 50 bp, Homo sapiens
tgttttcacgatagaaataaggaaggtctagagcttctattctttggcca

SEQ ID NO: 250 - DNA, 50 bp, Homo sapiens
tacagaagagcagagaccaaccttctcaaagttggtgagtattaacccag

SEQ ID NO: 251 - DNA, 50 bp, Homo sapiens
tcagtgtaaacataattaggccgtgagtttttgctcttactcccaggttt

SEQ ID NO: 252 - DNA, 50 bp, Homo sapiens
aacatatccagggaggacaaactctgggctggacaatgtatccacaaggg

SEQ ID NO: 253 - DNA, 50 bp, Homo sapiens
ggggtttgtgctatacactgggatgtctaattgcagcaataaagcctttc

SEQ ID NO: 254 - DNA, 50 bp, Homo sapiens
ttgagtaaggctcagagttgcagatgaggtgcagagaacatcctgtgact

SEQ ID NO: 255 - DNA, 50 bp, Homo sapiens
ttcatgctcattaggacattgaacaaatggcagagtaagaaagtttggcc

SEQ ID NO: 256 - DNA, 50 bp, Homo sapiens
gggggtttccacaatgtgagggggaaccaagaaaattttaaatacagtgt

SEQ ID NO: 257 - DNA, 50 bp, Homo sapiens
actttaagaaaaaacaaataattgttgcagaggtctctgtattttgcagc

SEQ ID NO: 258 - DNA, 50 bp, Homo sapiens
gctcgctaccagaaatcctaccgataagcccatcgtgactcaaaactcac

SEQ ID NO: 259 - DNA, 50 bp, Homo sapiens
ctgtaccagtgctggctgcaggtattaagtccaagtttattaactagata

SEQ ID NO: 260 - DNA, 50 bp, Homo sapiens
tctgtgaaaatctttctgcaaatgtctttgcttgcttgtactcacgtttt

SEQ ID NO: 261 - DNA, 50 bp, Homo sapiens
atttgagtgttgttggaccatgtgtgatcagactgctatctgaataaaat

SEQ ID NO: 262 - DNA, 50 bp, Homo sapiens
tggtttaatggaaaatgctctggaaaattcttttgcaacagttcatcgct

SEQ ID NO: 263 - DNA, 50 bp, Homo sapiens
ctatcagccccaagtggagcagaacagagggatttgggaggaatgtcctc

SEQ ID NO: 264 - DNA, 50 bp, Homo sapiens
tgagtcagtgtctttactgagctggaagcctctgaaagttattaaaggca

SEQ ID NO: 265 - DNA, 50 bp, Homo sapiens
gtcctttgatagcagaacaagaggctctgtgatcctctggacctcagatt

SEQ ID NO: 266 - DNA, 50 bp, Homo sapiens
ctttagatgtcccacgtcccttcaagcacatgaaagagctcacactggag

SEQ ID NO: 267 - DNA, 50 bp, Homo sapiens
gagatggggagggctaccacagagttatccactttacaacggagacacag

SEQ ID NO: 268 - DNA, 50 bp, Homo sapiens
aaaaggagacgatgtcaggcaaacactccttaccctgccatttctagtta

SEQ ID NO: 269 - DNA, 50 bp, Homo sapiens
cccaaagcctggggggtttggcccaaaccttccccctggtttttataaaa

SEQ ID NO: 270 - DNA, 50 bp, Homo sapiens
gtctgccctgctggctggaaacctggtagtgaaacaataatcccagatcc

SEQ ID NO: 271 - DNA, 50 bp, Homo sapiens
accgaatttggcaagaatgaaatggtgtcataaagatgggaggggagggt

SEQ ID NO: 272 - DNA, 50 bp, Homo sapiens
cagggtatcagatattgtgccttttggtgccaggttcaaagtcaagtgcc

SEQ ID NO: 273 - DNA, 50 bp, Homo sapiens
tgctggacaaagacaatgagatgattattggtggtgggatggctgttacc

SEQ ID NO: 274 - DNA, 50 bp, Homo sapiens
gagaagattcaggacctcttggtggactctggaaagttcatctacttaga

SEQ ID NO: 275 - DNA, 50 bp, Homo sapiens
tgaaagagaaagactgattacctcctgtgtggaagaaggaaacaccgagt

SEQ ID NO: 276 - DNA, 50 bp, Homo sapiens
ccctctcctcaacatcttgtccagcttattcaccgtatccaaatcaatat

SEQ ID NO: 277 - DNA, 50 bp, Homo sapiens
acatcgcctaaaaccgtgcatcgtaaacatttacctcaaagtcatcctct

SEQ ID NO: 278 - DNA, 50 bp, Homo sapiens
atacccacacagcaactggtccactgctttactgtctgttggataatggc

SEQ ID NO: 279 - DNA, 50 bp, Homo sapiens
ataatcacagttgtgttcctgacactcaataaacagtcactggaaagagt

SEQ ID NO: 280 - DNA, 50 bp, Homo sapiens
gtgttggagaggggctgtgtctgggtgagggatggcggggtactgatttt

SEQ ID NO: 281 - DNA, 50 bp, Homo sapiens
cttcaccgccctacttccacctccgcccagcctgtaatgtttatataagc

SEQ ID NO: 282 - DNA, 50 bp, Homo sapiens
ctgaatgccaagagcttcaagagtgtgtgtaaataaagccacacctttat

SEQ ID NO: 283 - DNA, 50 bp, Homo sapiens
gacaaccaattcaaatgattgtgctaacttatttcccctagttgacctgt

SEQ ID NO: 284 - DNA, 50 bp, Homo sapiens
gcttataaacacatttgaggaataggaggtccgggttttccataatgggt

SEQ ID NO: 285 - DNA, 50 bp, Homo sapiens
cgatagaattgaagcagtccacggggaggggatgatacaaggagtaaacc

SEQ ID NO: 286 - DNA, 50 bp, Homo sapiens
acaagcatttagatcataacatggtaaagcctattaccagccaatgttgt

SEQ ID NO: 287 - DNA, 50 bp, Homo sapiens
ttagggcagtggagaatcagggtgtatctaataaattccttcatggagct

SEQ ID NO: 288 - DNA, 50 bp, Homo sapiens
agctgctgacttgactgtcatcctgttcttgttagccattgtgaataaga

SEQ ID NO: 289 - DNA, 50 bp, Homo sapiens
gtcccaagggtcagtatattggaggaaagtaaaggagtgaatcagactgc

SEQ ID NO: 290 - DNA, 50 bp, Homo sapiens
gttcatcgtctcgcgtcgcaagaagtaagggctaggccatgactcgttcg

SEQ ID NO: 291 - DNA, 50 bp, Homo sapiens
agcacttactgtcaggcattcagaatgtgagcaatgacaataatttacct

SEQ ID NO: 292 - DNA, 50 bp, Homo sapiens
tgtatcttttcctgttaaacacacagacccctccccaatctggacattga

SEQ ID NO: 293 - DNA, 50 bp, Homo sapiens
gccaacagaacagaagaaaatgtttcagacggttccccaaatgccggttc

SEQ ID NO: 294 - DNA, 50 bp, Homo sapiens
tcctggatgcctctgaagagagggacagaccgtcagaaactggagagttt

SEQ ID NO: 295 - DNA, 50 bp, Homo sapiens
gtaaggcagacgagagaggcggaggtctcacagtgaaccacaggatctgg

SEQ ID NO: 296 - DNA, 51 bp, Homo sapiens
gtttctaacccataagtgcctcatacatacattgctagtctaaagagcttt

SEQ ID NO: 297 - DNA, 50 bp, Homo sapiens
acacatgccctgaatgaattgctaaatttcaaaggaaatggaccctgctt

SEQ ID NO: 298 - DNA, 50 bp, Homo sapiens
atgtgtaggaggaagagttcaggtggaaaaggagggagctactctcaggc

SEQ ID NO: 299 - DNA, 50 bp, Homo sapiens
cacccgttgtaggcgacgagcgtgaacgaaaacgtgtcggacggcttgta

SEQ ID NO: 300 - DNA, 50 bp, Homo sapiens
gacactttcgagctcccagctccagcttcgtctcaccttgagttaggctg

SEQ ID NO: 301 - DNA, 50 bp, Homo sapiens
aaaaggagtgagctatcatcagtgctgtgaaataaaagtctggtgtgcca

SEQ ID NO: 302 - DNA, 50 bp, Homo sapiens
ccacaagggttagtttgggccttaaaactgccaaggagtttccaaggatt

SEQ ID NO: 303 - DNA, 50 bp, Homo sapiens
gtgacctcggggtcccccttggtgagggtgccggtcttgtcgaagacgac

SEQ ID NO: 304 - DNA, 50 bp, Homo sapiens
tgtgcaaatacggcgagaagaagtgcatgagaaagtgctttataagctgt

SEQ ID NO: 305 - DNA, 50 bp, Homo sapiens
ccaatctaatttaaaccctcataacaggacataagcttgcgcccgcatct

SEQ ID NO: 306 - DNA, 50 bp, Homo sapiens
cctggttacaataatgaaactgtcgtggagtaaagagggaaacatgacca

SEQ ID NO: 307 - DNA, 50 bp, Homo sapiens
ctatccacagaagctggccttcgccgagtgcctgtgcagaggctgtatcg

SEQ ID NO: 308 - DNA, 50 bp, Homo sapiens
gggttacctcactttctaggttcccaagattcccaagttaaggaagcttt

SEQ ID NO: 309 - DNA, 50 bp, Homo sapiens
cctcagcttccaactctgattccaggacaggatggaaaacctttggacag

SEQ ID NO: 310 - DNA, 50 bp, Homo sapiens
tgccctacatagcaattttctgtggcactgagaaaccatgtatgaccaca

SEQ ID NO: 311 - DNA, 50 bp, Homo sapiens
agctgtttaattgaattggaatcgttccacttggaacccaagtttggaaa

SEQ ID NO: 312 - DNA, 50 bp, Homo sapiens
tgtggtttgcaatggtttactgatgagacagcaaaaatgagacaggacca

SEQ ID NO: 313 - DNA, 50 bp, Homo sapiens
agatgtctgtataaacaacctttgggtagcaggtggtcagttaggcagga

SEQ ID NO: 314 - DNA, 50 bp, Homo sapiens
ttagaaagaaaagtcttttattagtactgtgtagggaaggctaaagaaat

SEQ ID NO: 315 - DNA, 50 bp, Homo sapiens
tctgtgtcctaaagatgtgttctctataaaatacaaaccaacgtgcctaa

SEQ ID NO: 316 - DNA, 50 bp, Homo sapiens
atcctggcaaccttacaattcctctcggcatttgtcacttccatctcagc

SEQ ID NO: 317 - DNA, 50 bp, Homo sapiens
aacttaactcactggcgagaatacagcgtgggacccttcagccactacaa

SEQ ID NO: 318 - DNA, 50 bp, Homo sapiens
cagttcccagatgtgcgtgttgtggtccccaagtatcaccttccaatttc

SEQ ID NO: 319 - DNA, 50 bp, Homo sapiens
cacaaactagattctggacaccagtgtgcggaaatgcttctgctacattt

SEQ ID NO: 320 - DNA, 50 bp, Homo sapiens
gttgcagggcgaggtcaagagagttctgacctggatggcccatagacctg

SEQ ID NO: 321 - DNA, 50 bp, Homo sapiens
ccaatgtttctcttttggccctatacaaaggcaagaaggaaagaccaaga

SEQ ID NO: 322 - DNA, 50 bp, Homo sapiens
aatggaaggattagtatggcctatttttaaagctgctttgttaggttcct

SEQ ID NO: 323 - DNA, 50 bp, Homo sapiens
tcttggcagccatcctttttaagagtaagttggttacttcaaaaagagca

SEQ ID NO: 324 - DNA, 50 bp, Homo sapiens
ctgtgcagaagagctgccaggcagtgtcttagatgtgagacggaggccat

SEQ ID NO: 325 - DNA, 50 bp, Homo sapiens
tggggcactttgaaaacttcacaggcccactgctgcttgctgaaataaaa

SEQ ID NO: 326 - DNA, 50 bp, Homo sapiens
gaataggagggacatggaaccatttgcctctggctgtgtcacagggtgag

SEQ ID NO: 327 - DNA, 50 bp, Homo sapiens
gacacagcgagagtccaggaacaggcagacaagcgagaaagaggagaagc

SEQ ID NO: 328 - DNA, 50 bp, Homo sapiens
aactaaccccctttccctgctagaaataacaattagatgccccaaagcga

SEQ ID NO: 329 - DNA, 50 bp, Homo sapiens
acgatgatggttacccttcatggacgtcttaatcttccacacacatcccc

SEQ ID NO: 330 - DNA, 50 bp, Homo sapiens
aggctgtagaaggaaatataccttaacaggctgatttggagtgacccaga

SEQ ID NO: 331 - DNA, 50 bp, Homo sapiens
tggagataatctagaacacaggcaaaatccttgcttatgacatcacttgt

SEQ ID NO: 332 - DNA, 50 bp, Homo sapiens
tcctttctgcttagtgaatgaatactggaatccatctgtgttgatacaat

SEQ ID NO: 333 - DNA, 1869 bp, Homo sapiens
tacctggttgatcctgccagtagcatatgcttgtctcaaagattaagccatgcatgtctaagtacgcacggccggtacagtgaaactgcgaatggctcattaaatcagttatggttcctttggtcgctcgctcctctcccacttggataactgtggtaattctagagctaatacatgccgacgggcgctgacccccttcgcgggggggatgcgtgcatttatcagatcaaaaccaacccggtcagcccctctccggccccggccggggggcgggcgccggcggctttggtgactctagataacctcgggccgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacgaaaaataacaatacaggactctttcgaggccctgtaattggaatgagtccactttaaatcctttaacgaggatccattggagggcaagtctggtgccagcagccgcggtaattccagctccaatagcgtatattaaagttgctgcagttaaaaagctcgtagttggatcttgggagcgggcgggcggtccgccgcgaggcgagccaccgcccgtccccgccccttgcctctcggcgccccctcgatgctcttagctgagtgtcccgcggggcccgaagcgtttactttgaaaaaattagagtgttcaaagcaggcccgagccgcctggataccgcagctaggaataatggaataggaccgcggttctattttgttggttttcggaactgaggccatgattaagagggacggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcaaagctgaaacttaaaggaattgacggaagggcaccaccaggagtggagcctgcggcttaatttgactcaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccctcggatcggccccgccggggtcggcccacggccctggcggagcgctgagaagacggtcgaacttgactatctagaggaagtaaaagtcgtaacaaggtttccgtaggtgaacctgcggaaggatcatta

SEQ ID NO: 334 - DNA, 1793 bp, Homo sapiens
cgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttccccctttttgtcccccaacttgagatgtatgaaggcttttggtctccctgggagtgggtggaggcagccagggcttacctgtacactgacttgagaccagttgaataaaagtgcacacctta

SEQ ID NO: 335 - DNA, 2191 bp, Homo sapiens
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatatgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtcgctactg

SEQ ID NO: 336 - DNA, 925 bp, Homo sapiens
ggcacgagccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttg

SEQ ID NO: 337 - DNA, 3408 bp, Homo sapiens
cctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgtaagtgagtgtgctgctgtaagaaatctcccatgtgcataacaaattctgaatattttttgaggctaaagaagaccggggtgacaagcagatactgctgtgtaatggttacactaaccaaaagacaccagccactcagagttctatactgtaaagcgcagataacatttgtgtgttataccttgattggggaattaaaagtcatttaactgaagatgttgagaaacctgggctctggttttagtataccggaattacttttttccaattttagaaaatcaagcaggttagagaaaatagagatgaattaggggacactgtcttatggattcatttataagaagagaaccagccatatacacttggggagatttgccacatcttaaacttgaataatagtatgagtaatgcttaagggagtttaatagagaaggaaagctttggcagtgttttgagaacttaagtggctaaagagatgagacaaacatgcaggtcgctactggcatagtttcataattgtgtactcggaaattaaagtttgcttgtttcttggtctggattaaa

SEQ ID NO: 338 - DNA, 2139 bp, Homo sapiens
gtgagacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagccctgctccagaagttagcttcaccccaatcccagctacctcaaccaatgccgaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggccacgagcttgttctttgttctttgtcacagggactgaaaacctctcctcatgttctgctttcgattcgttaagagagcaacattttacccacacacagataaagttttcccttgaggaaacaacagctttaaaag

SEQ ID NO: 339 - DNA, 1484 bp, Homo sapiens
cccgtgaggaggaaaaggtgtgtccgctgccacccagtgtgagcgggtgacaccacccggttaggaaatcccagctcccaagagggtataaatccctgctttactgctgagctcctgctggaggtgaaagtctggcctggcagccttccccaggtgagcagcaacaaggccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaaaaaaaaaaaaaaaaaaaaaaaaaaaaa

SEQ ID NO: 340 - DNA, 1363 bp, Homo sapiens
gaggaaaagctttcggactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcactcacccagagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 341 - DNA, 1937 bp, Homo sapiens
cacctgtcattcgttcgtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggagattctccatcttgggcgaagggccactgtcccttcatgctgtcggaactccaggatgggaagagcaagattgtgcagaaggcagccccagaagtccaggaagatgtgaaggctttcaagacagatctgcctagctccctggtctcagtcagcctaaggaagccattttccggtccccaggagcaggagcagatctctgggaaggtcacacacctgattcagaacaatatgcctggaaactatgtcttcagttatgaccagtttttcagggacaagatcatggagaagaaacaggatcacacctaccgtgtgttcaagactgtgaaccgctgggctgatgcatatccctttgcccaacatttctttgaggcatctgtggcctcaaaggatgtgtccgtctggtgtagtaatgattacctgggcatgagccgacaccctcaggtcttgcaagccacacaggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccac

SEQ ID NO: 342 - DNA, 2673 bp, Homo sapiens
cggggtcacgggcagttgcagccgcggccgagcagccagccgctaagaaagagctcgccgctgccgctcccggagccgccgaggccagcttcgcggcgctgccccgcggcgggagaggaggctgcagaagagcggaggcggccagcgggagcggcggggctcagcgcgcacactcagcggccggggagcctcccgagctctgcgcccgcacgcgccagccgcggctcgcgcctttcttggcctccgggcgcccgacctctcctcccccgcgccggctcgccggggccgcggcggcccaaggagcagcatgaatctgcggctctgcgtgcaggcgctcctgctgctctggctctccttgaccgcggtgtgtggagggtccctgatgccgcttcccgatgggaatgggctggaagacggcaatgtccgccacctggtgcagcccagagggtcaaggaatgggccagggccctggcagggaggtcggaggaaattccgccgccagcggccccgcctctcccataagggacccatgcctttctgaagcaggactgaaggggcccccaagtgcccacccccggcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactgactttggagacctagccccagaaagcctcccttcttctccaggtcccctccgccctagtccctgcctgtctcatctaacgccccaaaccttcatttgggccttccttcctcatgtctgccctgagcgcggggtggaagtgctcccttctgtgggctccagcagatcccttgttttcctgtcagttggacccctcacctggcctccagggaagaatgcagagaaaagcaaggagagactctagttaagaggtgctggctgccgggatccagacagggcacattgggggcatggaagtgccagggtggttttcaggagctctggtgaagtgggtggagcatcagcgtttgctcagttaagggagaggtagagaggggcccgtgaagtcctttgtcacttctcttgccttagtgtgcctcccaatactcccttcttcctgcccccacaccccatccccagctagcccaagctccaggtcaggaggggagggtgctgggcctgacatggctatataccctcccaggagtaaaagccaagcaagaggttgtttttgccaagaatcacagaatgttagagctgacaggacccttgaaggtcacttagccttcttaggcaaacgcctgcaaaacagaagcctggagaggggagtgacctgctcagagtcattgcagagccgggatggggaccaggtctcccatctcctactttatgacgccctcttccctcttgatgatgtcttttcaaagcaaatgaagtgccttttcccgaggctggggctgggggtggctgggaggggaagggaagggagaggcaagctggctgtgaactgtcctgttgtggggctggagctgctcccacctccctgacctacccctgctgcaccattcccccagctgggctggaaggttccataactggccagctgcccccataactggcagcattcccagacccagggtactctaataggggcggctcaggcactgagactaccgctcaaccccagggtggttttcaggagtccgaggtagccttcaatcactggactccatggccttcccttcgtgttgaccggaccttccttccagggcttttcctttgggggaggcggagaggggagaagaaggaagggaagggcagaaggaaggagggaagaaaagaaagcaaaggaacagaaggaaggaaagaaagatgggaggaagtgcagcaggaatagcaccctctccccgggaggccctagcttccgtgaggggccatcaccagccattccttggagggggctttctccccttttgcttgagcagggttcccaggagggagaaagagaagacaagagcctgatgcccaactttgtgtgtgtggggacgggggagtcagggccccccaagtcccacaatagccccaatgtttgcctatccacctcccccaagcccctttacctatgctgctgctaacgctgctgctgctgctgctgctgcttaaaggctcatgcttggagtggggactggtcggtgcccagaaagtctcttctgccactgacgcccccatcagggattgggccttctttcccccttcctttctgtgtctcctgcctcatcggcctgccatgacctgcagccaagcccagccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctgaaaaaaaaaaaaaaaaaaa

SEQ ID NO: 343 - DNA, 1549 bp, Homo sapiens
aaaccctctgtaaagtaacagaagttagaaggggaaatgtcgcctctctgaagattacccaaagaaaaagtgatttgtcattgctttatagactgtaagaagagaacatctcagaagtggagtcttaccctgaaatcaaaggatttaaagaaaaagtggaatttttcttcagcaagctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtagcctccgtcatctcttctgggatacatggatcgtggggatcatgaggcattcttcccttaacaaatttaagctgttttacccactacctcaccttcttaaaaacctctttcagattaagctgaacagttacaagatggctggcatccctctcctttctccccatatgcaatttgcttaatgtaacctcttcttttgccatgtttccattctgccatcttgaattgtcttgtcagccaattcattatctattaaacactaatttgag

SEQ ID NO: 344 - DNA, 2867 bp, Homo sapiens
tcccgtggagcagaggggcaaagtggcaggaacctcttaaagggcgagacgggcggcgaccgagaacgcggtcggcccggtccccgccgcacccagcccagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacacaaggtgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctcaccattacaattaagaattatttttagagtcttcttatttctgaagcatgtgaatattatctcgatcgttaaaagtcctgctcaggaagaactcagagaagatccagattctgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccacgaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggggtttttaattgggtggtttgtaaccccttcagcctag

SEQ ID NO: 345 - DNA, 3354 bp, Homo sapiens
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctagcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacaggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcctgtgataatggtcactgtatgctgaatggaacacatggtccatcttcagagaagaaatcaaacatccctgacttaagcatatatttaaagggtacgtatagaatataatttcctttgtgatgtacatcttaatggtcagaatttaaaggcaaaatttcatgccattgtactgaaaatacattaaggttttgtgttatcctctaggagatgtttttgattcagcctctgatcccgtgccattaccacctgccaggcctccaactcgggacaatccaaagcatggttcttcactcaacaggacgccctctgattatgatcttctcatccctccattaggttgaaacctttaaaaaagttttgaacaacccacccctccttcttttaatttcagaattttcagaattcagagttcagtataacacagactcactgggttgtgaatttgcctgaaatttgaatgggttctccaggtgccggtgactcccaagttcacgagaccattactccatgtagatgattaaggtagtagtgtagtagttgggcatcagtcaggttttaagcaagttgttttgtccatactaaatgtagtctaaaaacacatgagagctttgtgctctagtagttttgaagtgatgacttgaagtgttgagattttctttaagtataataattcttaataaatatgaacttgcttttcttgcagcatgagcaccagttccacttacgctaattaaattatgcaaaattaaatagttgtatgtagagaactgataataaattctgttttattctaatcattacaactgtaacacattcaaaaaaaaaaa

SEQ ID NO: 346 - DNA, 3655 bp, Homo sapiens
cttcagatagattatatctggagtgaaggatcctgccacctacgtatctggcatagtattctgtgtagtgggatgagcagagaacaaaaacaaaataatccagtgagaaaagcccgtaaataaaccttcagaccagagatctattctccagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttggtttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatataggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctttctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttcta

SEQ ID NO: 347 - DNA, 5595 bp, Homo sapiens
gcggagatgtgcaagtggcgaagcttgaccgagagcaggctggagcagccgcccaactcctggcgcgggatctgctgaggggtcacggattttaggtgatgggcaagtcagaaagtcagatggatataactgatatcaacactccaaagccaaagaagaaacagcgatggactcgactggagatcagcctctcggtccttgtcctgctcctcaccatcatagctgtgagaatgatcgcactctatgcaacctacgatgatggtatttgcaagtcatcagactgcataaaatcagctgctcgactgatccaaaacatggatgccaccactgagccttgtagagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgagattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatagagttaggcaccagaagaagagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgcgattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatact

SEQ ID NO: 348 - DNA, 1466 bp, Homo sapiens
cttagtaacacgttgatgagaaatctactttttccactcttgactcactctgagccttcacagggcagtctgcgaagattgcaggcattgtttgttcttgtcttggatttatgcctttaaatttcaccttttattacacagctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaagctccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctctacattaatacagaggcacaacaattcttccctgaatacaagaactcagaaagcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatccagaaaaaaaaaa

SEQ ID NO: 349 - DNA, 2341 bp, Homo sapiens
gattctgtgtgtgtcctcagatgctcagccacagacctttgagggagtaaagggggcagacccacccaccttgcctccaggctctttccttcctggtcctgttctatggtggggctcccttgccagacttcagactgagaagtcagatgaagtttcaagaaaaggaaattggtgggtgacagagatgggtggaggggctggggaaaggctgtttacttcctcctgtctagtcggtttggtccctttagggctccggatatctttggtgacttgtcctctccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccctatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatgataaaaaaaaaaaaaaaaaaaaaaaaaaaaaaaaaaa

SEQ ID NO: 350 - DNA, 887 bp, Homo sapiens
tctttggtgacttgtccactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacaaatgacccccatcccatgggagtaataagagcagtggcagcagcatctctgaacatttctctggatttgcaaccccatcatcctcaggcctctc

SEQ ID NO: 351 - DNA, 1991 bp, Homo sapiens
acaggggtgaaggcccagagaccagcagaacggcatcccagccacgacggccactttgctctgtctgctgtccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgatgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtgcccaacgctctgggagagccccaggtgccctcccagcaggccacctcctgctgtttctcacccttggtgtcctttctctgctccttttggtgactggagcctttggctttcacctttggagaagacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaacgtcctgtctagcagc

SEQ ID NO: 352 - DNA, 3189 bp, Homo sapiens
tttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctaacaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcggaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacatacactccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacacggttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaaaaaaaaaaaaaaa

SEQ ID NO: 353 - DNA, 2657 bp, Homo sapiens
cccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctggagctggaaccctgaccactcttcaggaagaaaggagtctgcacatgcagctgcaccctccctccgatccttcctcccacctccccctcccccttctcccacccctgcccccacttcctgtttgggccctctcccatccagtgtctcacagccctgcttaccagataatgctactttatttatacactgtctagggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcgctccctggagcagactctggtcttctttgggtaaacgtgtgacgggggaaagccaaggtctggagaagctcccaggaacaactgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcttttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgaacagggatcctggtttcaatgacggttggaaatagaaatttccagagaagagagtattgggtagatattttttctgaatacaaagtgatgtgtttaaatactgcaattaaagtgatactgaaacacaaaaaaaaaaaaaaaaaa

SEQ ID NO: 354 - DNA, 2230 bp, Homo sapiens
cttggagacaacatgtggttcttgacaactctgctcctttgggttccagttgatgggcaagtggacaccacaaaggcagtgatcactttgcagcctccatgggtcagcgtgttccaagaggaaaccgtaaccttgcattgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 355 - DNA, 5010 bp, Homo sapiens
ggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggttcgcttactttgagtgatcctccaacttcatttgatgctaaataggagataccaggttgaaagacctctccaaatgagatctaagcctttccataaggaatgtagcaggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccatttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagcagcatacatttataatgtttgctattgacaagtcattttaatttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcatataaacgtgtagtacagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagtagggccttttggaggtaaaggtata

SEQ ID NO: 356 - DNA, 784 bp, Homo sapiens
agcatttgctcaggcagcctctctgggaagatgctgcttcttcctctccccctgctgctctttctcttgtgctccagagctgaagctggggagatcatcgggggcacagaatgcaagccacattcccgcccctacatggcctacctggaaattgtaacttccaacggtccctcaaaattttgtggtggtttccttataagacggaactttgtgctgacggctgctcattgtgcaggaaggtctataacagtcacccttggagcccataacataacagaggaagaagacacatggcagaagcttgaggttataaagcaattccgtcatccaaaatataacacttctactcttcaccacgatatcatgttactaaagttgaaggagaaagccagcctgaccctggctgtggggacactccccttcccatcacaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcc

SEQ ID NO: 357 - DNA, 5084 bp, Homo sapiens
gatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttgccatactttgtctgaaaaattcctttgtgtttctattgacttcaatgatagtaagaaaagtggttgttagttatagatgtctaggtacttcaggggcacttcattgagagttttgtcaatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattc

SEQ ID NO: 358 - DNA, 3646 bp, Homo sapiens
cctgaagggaggatgggctaaggcaggcacacagtggcggagaagatgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggagactgaggcatgccctgtggccctcacttccagacctgcaccgggtcctaggccagtaccttagggacactgcagccctgagcccgcccaaggccacagtctcagatacctgtgaagaagtggaacccagcctccttgaaatcctccccaagtcctcagagaggactcctttgcccctgtgttcctcccaggcccagatggactaccgaagattgcagccttcttgcctggggaccatgcccctgtctgtgtgcccacccatggctgagtcagggtcctgctgtaccacccacattgccaaccattcctacctaccactaagctattggcagcagccttgaggacaggctcctcactcccagttccctggacagagctaaactctcgagacttctctgtgaacttccctaccctacccccacaacacaagcaccccagacctcacctccatccccctctgtctgccctcacaattaggcttcattgcactgatcttactctactgctgctgacataaaaccaggaccctttctccacaggcaggctcatttcactaagctcctcctttacttcctctctcctctttgatgtcaaacgccttgaaaacaagcctccacttccccacacttcccatttactcttgagactacttcaattagttcccctactacactttgctagtgaactgcccaggcaaagtgcacctcaaatcttctaattccaagatccaataggatctcgttaatcatcagttcctttgatctcgctgtaagatttgtcaaggctgactactcacttctcctttaaattctttcctaccttggtcctgcctctttgagtatattagtaggttttttttatttgtttgagacagggtctcactctgtcacccaggctgcagtgcaatggcgcgatctcagctcactgcaacctccacctccgggttcaagcgattcttgtgcctcggcctccctagtagctgggattacaggcgcacaccaccacacacagctaatttttttttttttttttttttttttttttttttttagacggagccttgcctgttgccagactggagtgcagtggcacgatctcggctcactgcaacctctgcctcccgggttcaagccattctgcctcagcctcccaagtagctgggagtacagcgtctgccaccatgcctaatttttttctatttttaggagagaccggttttcaccacgttggccaggatggtctcgatatctgatctcgtgatccgcctgcctctgcctcccaaagtgctgggattacaggtgtgacccactgcgcacagccccagctaattttcatatttttagtagagacagggttttgccatgttgcccaggctggtcttgaactcctaacctcgggtgatccacccaccttggcctcccaaagtgttaggattacaggcatgagccactgcgcccggctgagtgtactagtagttaagagaataaactagatctagaatcagagctggattcaattcctgtccttcacatttactagctgtgcaaccttgggcacataacttaatgtctttgagccttagttttttcatctgtaaaacagggataataacagcaccccatagagttgtgacgaggattgagataatctaagtaaagcacagtccctaggacatagtaaatgattcatatatccgaactactgttataattattccttcttactctcctcttctagcatttcttccaattattacagtccttcaagattccatttcttaacagtctccaatcccatctattctctgcctttactatatgttgaccattccaaagttcttatctctagctcagacatctactacagcactgtgatgctttatgcaactaactgtttacatatctgtcccctgctactagattgtgagctccttgagggaaaggaacatgatttatttgtccttttcccccagcacctagagtagtgcttggtgcatgatagtaggccttcaataaattttttctaaatgaatga

SEQ ID NO: 359 - DNA, 4010 bp, Homo sapiens
cggagggggcgggccgggctgcgttcgctccagccgcggctctacagcagcgggcggcgggacccgggacccagcttggcgacggcgattctcgacgcgggcccccaggattctcccggcgccccacctctggagcagcccctgccgccagcgtcaggtccaccccggaatcccagggactctcggcgccgaacggacccgggccggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctagatcaacaagcaaaggaggtgccaagcctgtttgtcttcattgtgacactggagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaaagggaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgcaaa

SEQ ID NO: 360 - DNA, 1849 bp, Homo sapiens
acttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttg

SEQ ID NO: 361 - DNA, 1326 bp, Homo sapiens
atgtcccccatctcaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaaggtgagctcctctgaggtggcggtgactgggatggcctcaagtgccatcgcagctcaaagtgggcaggcctgggtctgggctcataggcacattggggaggaacgggatgtgggttgttggtggtggctgctggcctcagaggttgacgcccacctgctccctgtccccggccttccacagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctga

SEQ ID NO: 362 - DNA, 1498 bp, Homo sapiens
gcaaaggccaaggccagccaggacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccaggtgaaccggccactgaccatgcggaaggatggtattcagactcgaaaccgcaaggcatctggaaaagggaaaaagaaacggggctccagtctgggaggcacaggagcagccgaaggaccagctggtggctttatggtggtggctgggggcagcggtagcgggaattgtggggaggtggcttcaggcctgacactgggccccccaggtactgcccatctctaccaaggcctgggccctgtggtgctgtcagggcctgttagccacctcatgcctttccctggacccctactgggctcacccacgggctccttccccacaggccccatgccccccaccaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctg

SEQ ID NO: 363 - DNA, 3334 bp, Homo sapiens
attcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcgcagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactctggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtgtggacacagctgctccgggccttggaggagagggccattccaatctggtgggtgctggtgggtgtgctgggtggcctgctgctgctcaccatcctggtcctggccatgtggaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctg

SEQ ID NO: 364 - DNA, 738 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaag

SEQ ID NO: 365 - DNA, 878 bp, Homo sapiens
cagattttcaggttgattgatgtgggacagcagccacaatgaggaactcctatagatttctggcatcctctctctcagttgtcgtttctctcctgctaattcctgaagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaa

SEQ ID NO: 366 - DNA, 576 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggc

SEQ ID NO: 367 - DNA, 589 bp, Homo sapiens
accaaggccagtcctgagcaggcccaactccagtgcagctgcccaccctgccgccatgtctctgaccaagactgagaggaccatcattgtgtccatgtgggccaagatctccacgcaggccgacaccatcggcaccgagactctggagaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaagctcctgtcccactgcctgctggtcaccctggccgcgcgcttccccgccgacttcacggccgaggcccacgccgcctgggacaagttcctatcggtcgtatcctctgtcctgaccgagaagtaccgctgagcgccgcctccgggacccccaggacaggctgcggcccctcccccgtcctggaggttccccagccccacttaccgcgtaatgcgccaataaaccaatgaacgaagc

SEQ ID NO: 368 - DNA, 626 bp, Homo sapiens
acatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgc

SEQ ID NO: 369 - DNA, 624 bp, Homo sapiens
acactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcaggctcttgggcaatgtgctggtgtgtgtgctggcccgcaactttggcaaggaattcaccccacaaatgcaggctgcctatcagaaggtggtggctggtgtggctaatgccctggctcacaagtaccattgagatcctggactgtttcctgataaccataagaagaccctatttccctagattctattttctgaacttgggaacacaatgcctacttcaagggtatggcttctgcctaataaagaatgttcagctcaacttc

SEQ ID NO: 370 - DNA, 816 bp, Homo sapiens
caacaaaaaagagcctcaggatccagcacacattatcacaaacttagtgtccatccatcactgctgaccctctccggacctgactccacccctgagggacacaggtcagccttgaccaatgacttttaagtaccatggagaacagggggccagaacttcggcagtaaagaataaaaggccagacagagaggcagcagcacatatctgcttccgacacagctgcaatcactagcaagctctcaggcctggcatcatggtgcattttactgctgaggagaaggctgccgtcactagcctgtggagcaagatgaatgtggaagaggctggaggtgaagccttgggcagactcctcgttgtttacccctggacccagagattttttgacagctttggaaacctgtcgtctccctctgccatcctgggcaaccccaaggtcaaggcccatggcaagaaggtgctgacttcctttggagatgctattaaaaacatggacaacctcaagcccgcctttgctaagctgagtgagctgcactgtgacaagctgcatgtggatcctgagaacttcaagctcctgggtaacgtgatggtgattattctggctactcactttggcaaggagttcacccctgaagtgcaggctgcctggcagaagctggtgtctgctgtcgccattgccctggcccataagtaccactgagttctcttccagtttgcaggtgttcctgtgaccctgacaccctccttctgcacatggggactgggcttggccttgagagaaagccttctgtttaataaagtacattttcttcagtaatc

SEQ ID NO: 371 - DNA, 584 bp, Homo sapiens
acactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatcac

SEQ ID NO: 372 - DNA, 651 bp, Homo sapiens
attgagcgcgcgcggtcccgggatctccgacgaggccctggacccccgggcggcgaagctgcggcgcggcgccccctggaggccgcgggacccctggccggtccgcgcaggcgcagcggggtcgcagggcgcggcgggttccagcgcggggatggcgctgtccgcggaggaccgggcgctggtgcgcgccctgtggaagaagctgggcagcaacgtcggcgtctacacgacagaggccctggaaaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccagctcctgggccactgcctgctggtaaccctcgcccggcactaccccggagacttcagccccgcgctgcaggcgtcgctggacaagttcctgagccacgttatctcggcgctggtttccgagtaccgctgaactgtgggtgggtggccgcgggatccccaggcgaccttccccgtgtttgagtaaagcctctcccaggagca

SEQ ID NO: 373 - DNA, 1157 bp, Homo sapiens
gctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactgggaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttc

SEQ ID NO: 374 - DNA, 1096 bp, Homo sapiens
atgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaatacatgcctggggtaagccacccggctacctaattcctcagtaacctccatctaaaatctccaaggaagcaataaattccttttatgag

SEQ ID NO: 375 - DNA, 1182 bp, Homo sapiens
tagttctccctgagtgagacttgcctgcttctctggcccctggtcctgtcctgttctccagcatggtgtgtctgaagctccctggaggctcctgcatgacagcgctgacagtgacactgatggtgctgagctccccactggctttggctggggacacccgaccacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagattggaccttccagaccctggtgatgctggaaacagttcctcggagtggagaggtttacacctgccaagtggagcacccaagtgtgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggattcctgagctgaaatgcagatgaccacattcaaggaagaaccttctgtcccagctttgcagaatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagtt

SEQ ID NO: 376 - DNA, 2610 bp, Homo sapiens
ggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagaagtattcatccagtgtgcacgaccctaacggtgaatacatgttcatgagagcagtgaacacagccaaaaaatctagactcacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtacttaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatcccaagcatgggacacctcaagatgaataataattcacaaaatttctgtgaaatcaaatccagttttaagaggagccacttatcaaagagattttaacagtagtaagaaggcaaagaataaacatttgatattcagcaactgaaaaaaaaaaa

SEQ ID NO: 377 - DNA, 1145 bp, Homo sapiens
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtg

SEQ ID NO: 378 - DNA, 924 bp, Homo sapiens
cagagccccacgaaggaccagaacaagacagagtgcctcctgccgatccaaacatgagccgcctgcccgtcctgctcctgctccaactcctggtccgccccggactccaagctcccatgacccagacaacgcccttgaagacaagctgggttaactgctctaacatgatcgatgaaattataacacacttaaagcagccacctttgcctttgctggacttcaacaacctcaatggggaagaccaagacattctgatggaaaataaccttcgaaggccaaacctggaggcattcaacagggctgtcaagagtttacagaacgcatcagcaattgagagcattcttaaaaatctcctgccatgtctgcccctggccacggccgcacccacgcgacatccaatccatatcaaggacggtgactggaatgaattccggaggaaactgacgttctatctgaaaacccttgagaatgcgcaggctcaacagacgactttgagcctcgcgatcttttgagtccaacgtccagctcgttctctgggccttctcaccacagagcctcgggacatcaaaaacagcagaacttctgaaacctctgggtcatctctcacacattccaggaccagaagcatttcaccttttcctgcggcatcagatgaattgttaattatctaatttctgaaatgtgcagctcccatttggccttgtgcggttgtgttctcatttttatcccattgagactatttatttatgtatgtatgtatttatttatttattgcctggagtgtgaactgtatttattttagcagaggagccatgtcctgctgcttctgcaaaaaactcagagtggggtggggagcatgttcatttgtacctcgagttttaaactggttcctagggatgtgtgagaataaactagactctgaac

SEQ ID NO: 379 - DNA, 4932 bp, Homo sapiens
ggcagggcacacctggattgcattagaatgagactcactacccagttcaggtgtgttgcgttgtgggtctccggcacatttcagaggctgattaggaccctgaccccacactggggtttacacccctaaaagcaggtgtgtcccgtggcaactgagtgggtgcgtgaaaaggggggatcatcaattaccagctggagcaatcgaatcggttaaatgtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggctcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccagacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctcggcggcagaaaccgggagtggggccgggcgagtgcgcggcatcccaggccggcccgaacgtccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgcttagtgttgaatgttccccaccgagagcgcatggcttgggaagcgaggcgcgaacccgggccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatgacttccggaatct

SEQ ID NO: 380 - DNA, 4740 bp, Homo sapiens
tggcttccttgtggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacactccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagcccccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgagcccccaggctgctggacacgtcggacagcgaagtatccccgacaggacgggcttgggcttccatttgtgtgtgtgcaagtgtgtatgtgcgtgtgtgcgagtgtgtgcaagtgtctgtgtgcaagtgtgtgcacgtgtgcgtgtgcgtgcatgtgcactcgcacgcccatgtgtgagtgtgtgcaagtatgtgagtgtgtccagtgtgtgtgcgtgtgtccatgtgtgtgcagtgtgtgcatgtgtgcgagtgtgtgcatgtgtgtgctcaggggctgtggctcacgtgtgtgactcagagtgtctctggcgtgtgggtaggtgacggcagcgtagcctctccggcagaagggaactgcctgggctcccttgtgcgtgggtaagccgctgctgggttttcctccgggagaggggacggtcaatcctgtgggtgaagagagagggaaacacagcagcatctctccactgaaagaagtgggacttcccgtcgcctgcgagcctgcggcctgctggagcctgcgcagcttggatggatactccatgagaaaagccgtgggtggaaccaggagcctcctccacaccagcgctgatgcccaataaagatgcccactgaggaatcatgaagcttcctttctggattcatttattatttcaatgtgactttaattttttggatggataagcctgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacaccacacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcatctcttgttattgcatctgctgagttaataaatcaaatatatgtcaaaaaaaaaaaaaaaaaaaaaaaaaaaaaaaaaaaaaaaaat

SEQ ID NO: 381 - DNA, 2798 bp, Homo sapiens
cgttgctgtcgctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcagaaaaaaaaaaaaaaaaaa

SEQ ID NO: 382 - DNA, 1837 bp, Homo sapiens
gagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttacaaagcc

SEQ ID NO: 383 - DNA, 1678 bp, Homo sapiens
gcatatactgtcatcatcttggaaagaaaaggctgagaacgtaaaactgaggacagaggaggaaagcagggtgacccctgatgttgccctagaaaatggaaaacaaaacacagcaaaacagaaaaacagaagatctgactctgcctttagccaggaaaacagtttgggggagtaaaaagtattagggaaaagagtgggcattttgcctggaaaaaaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcggctcctcaggtctttagcctccaccttgtctaagctttggtctataaagtgcgctacagaaaaaaaaaaaaaaaaaaaaaaa

SEQ ID NO: 384 - DNA, 2106 bp, Homo sapiens
agtttcccttccgctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttcttcccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagccgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctcccacctttacacatgcccaggcagcacctcaggccctttgtggggcagggaagctgaggcagtaagcgggcaggcagagctggaggcctttcaggccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgcgtggcctatccactcctcacatccacacactgcacccccactcctggggcagggccaccagcatccaggcggccagcaggcacctgagtggctgggacaagggatcccccttccctgtggttctattatattataattataattaaatatgagagcatgct

SEQ ID NO: 385 - DNA, 439 bp, Homo sapiens
ccgcagcatgagctccgcagccgggttctgcgcctcacgccccgggctgctgttcctggggttgctgctcctgccacttgtggtcgccttcgccagcgctgaagctgaagaagatggggacctgcagtgcctgtgtgtgaagaccacctcccaggtccgtcccaggcacatcaccagcctggaggtgatcaaggccggaccccactgccccactgcccaactgatagccacgctgaagaatggaaggaaaatttgcttggacctgcaagccccgctgtacaagaaaataattaagaaacttttggagagttagctactagctgcctacgtgtgtgcatttgctatatagcatacttcttttttccagtttcaatctaactgtgaaagaaacttctgatatttgtgttatccttatgattttaaataaacaaaataaatc

SEQ ID NO: 386 - DNA, 2705 bp, Homo sapiens
tgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgactttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaacgaaatgcttgttgaatcaggggcaaacggagtacagacgtctcaagactgaaacggccccattgcctggtctagtagcggatctcactcagccgcagacaagtaatcactaacccgttttattctatcctatctgtggatgtataaatgctgggggccagccctggataggtttttatgggaattctttacaataaacatagcttgtacttg

SEQ ID NO: 387 - DNA, 6317 bp, Homo sapiens
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacagaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacgcaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacgcttaaaacctagaacttcaaaatgttcgtattctattcaaaaggaaatatatatatatatatatatatatatatatatatatataaattaaaaaggaaagaaaactaacaaccaaccaaccaaccaaccaaccacaaaccaccctaaaatgacagccgctgatgtctgggcatcagcctttgtactctgtttttttaagaaagtgcagaatcaacttgaagcaagctttctctcataacgtaatgattatatgacaatcctgaagaaaccacaggttccatagaactaatatcctgtctctctctctctctctctctctctcttttttttttctttttccttttgccatggaatctgggtgggagaggatactgcgggcaccagaatgctaaagtttcctaacattttgaagtttctgtagttcatccttaatcctgacacccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattatttttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcagaataattcttccagtgcaacaaaatcaattttttgctaaacgactccgagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatgacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaatct

SEQ ID NO: 388 - DNA, 6557 bp, Homo sapiens
agagggcaaggagagagcagagaacacactttgccttctctttggtattgagtaatatcaaccaaattgcagacatctcaacactttggccaggcagcctgctgagcaaggtacctcagccagcatggcagcctctttcccacccaccttgggactcagttctgccccagatgaaattcagcacccacatattaaattttcagaatggaaatttaagctgttccgggtgagatcctttgaaaagacacctgaagaagctcaaaaggaaaagaaggattcctttgaggggaaaccctctctggagcaatctccagcagtcctggacaaggctgatggtcagaagccagtcccaactcagccattgttaaaagcccaccctaagttttcaaagaaatttcacgacaacgagaaagcaagaggcaaagcgatccatcaagccaaccttcgacatctctgccgcatctgtgggaattcttttagagctgatgagcacaacaggagatatccagtccatggtcctgtggatggtaaaaccctaggccttttacgaaagaaggaaaagagagctacttcctggccggacctcattgccaaggttttccggatcgatgtgaaggcagatgttgactcgatccaccccactgagttctgccataactgctggagcatcatgcacaggaagtttagcagtgccccatgtgaggtttacttcccgaggaacgtgaccatggagtggcacccccacacaccatcctgtgacatctgcaacactgcccgtcggggactcaagaggaagagtcttcagccaaacttgcagctcagcaaaaaactcaaaactgtgcttgaccaagcaagacaagcccgtcagcgcaagagaagagctcaggcaaggatcagcagcaaggatgtcatgaagaagatcgccaactgcagtaagatacatcttagtaccaagctccttgcagtggacttcccagagcactttgtgaaatccatctcctgccagatctgtgaacacattctggctgaccctgtggagaccaactgtaagcatgtcttttgccgggtctgcattctcagatgcctcaaagtcatgggcagctattgtccctcttgccgatatccatgcttccctactgacctggagagtccagtgaagtcctttctgagcgtcttgaattccctgatggtgaaatgtccagcaaaagagtgcaatgaggaggtcagtttggaaaaatataatcaccacatctcaagtcacaaggaatcaaaagagatttttgtgcacattaataaagggggccggccccgccaacatcttctgtcgctgactcggagagctcagaagcaccggctgagggagctcaagctgcaagtcaaagcctttgctgacaaagaagaaggtggagatgtgaagtccgtgtgcatgaccttgttcctgctggctctgagggcgaggaatgagcacaggcaagctgatgagctggaggccatcatgcagggaaagggctctggcctgcagccagctgtttgcttggccatccgtgtcaacaccttcctcagctgcagtcagtaccacaagatgtacaggactgtgaaagccatcacagggagacagatttttcagcctttgcatgcccttcggaatgctgagaaggtacttctgccaggctaccaccactttgagtggcagccacctctgaagaatgtgtcttccagcactgatgttggcattattgatgggctgtctggactatcatcctctgtggatgattacccagtggacaccattgcaaagaggttccgctatgattcagctttggtgtctgctttgatggacatggaagaagacatcttggaaggcatgagatcccaagaccttgatgattacctgaatggccccttcactgtggtggtgaaggagtcttgtgatggaatgggagacgtgagtgagaagcatgggagtgggcctgtagttccagaaaaggcagtccgtttttcattcacaatcatgaaaattactattgcccacagctctcagaatgtgaaagtatttgaagaagccaaacctaactctgaactgtgttgcaagccattgtgccttatgctggcagatgagtctgaccacgagacgctgactgccatcctgagtcctctcattgctgagagggaggccatgaagagcagtgaattaatgcttgagctgggaggcattctccggactttcaagttcatcttcaggggcaccggctatgatgaaaaacttgtgcgggaagtggaaggcctcgaggcttctggctcagtctacatttgtactctttgtgatgccacccgtctggaagcctctcaaaatcttgtcttccactctataaccagaagccatgctgagaacctggaacgttatgaggtctggcgttccaacccttaccatgagtctgtggaagaactgcgggatcgggtgaaaggggtctcagctaaacctttcattgagacagtcccttccatagatgcactccactgtgacattggcaatgcagctgagttctacaagatcttccagctagagataggggaagtgtataagaatcccaatgcttccaaagaggaaaggaaaaggtggcaggccacactggacaagcatctccggaagaagatgaacctcaaaccaatcatgaggatgaatggcaactttgccaggaagctcatgaccaaagagactgtggatgcagtttgtgagttaattccttccgaggagaggcacgaggctctgagggagctgatggatctttacctgaagatgaaaccagtatggcgatcatcatgccctgctaaagagtgcccagaatccctctgccagtacagtttcaattcacagcgttttgctgagctcctttctacgaagttcaagtataggtatgagggaaaaatcaccaattattttcacaaaaccctggcccatgttcctgaaattattgagagggatggctccattggggcatgggcaagtgagggaaatgagtctggtaacaaactgtttaggcgcttccggaaaatgaatgccaggcagtccaaatgctatgagatggaagatgtcctgaaacaccactggttgtacacctccaaatacctccagaagtttatgaatgctcataatgcattaaaaacctctgggtttaccatgaaccctcaggcaagcttaggggacccattaggcatagaggactctctggaaagccaagattcaatggaattttaagtagggcaaccacttatgagttggtttttgcaattgagtttccctctgggttgcattgagggcttctcctagcaccctttactgctgtgtatggggcttcaccatccaagaggtggtaggttggagtaagatgctacagatgctctcaagtcaggaatagaaactgatgagctgattgcttgaggcttttagtgagttccgaaaagcaacaggaaaaatcagttatctgaaagctcagtaactcagaacaggagtaactgcaggggaccagagatgagcaaagatctgtgtgtgttggggagctgtcatgtaaatcaaagccaaggttgtcaaagaacagccagtgaggccagaaattggtcttgtggttttcatttttttcccccttgattgattatattttgtattgagatatgataagtgccttctatttcatttttgaataattcttcatttttataattttacatatcttggcttgctatataagattcaaaagagctttttaaatttttctaataatatcttacatttgtacagcatgatgacctttacaaagtgctctcaatgcatttacccattcgttatataaatatgttacatcaggacaactttgagaaaatcagtccttttttatgtttaaattatgtatctattgtaaccttcagagtttaggaggtcatctgctgtcatggatttttcaataatgaatttagaatacacctgttagctacagttagttattaaatcttctgataatatatgtttacttagctatcagaagccaagtatgattctttatttttactttttcatttcaagaaatttagagtttccaaatttagagcttctgcatacagtcttaaagccacagaggcttgtaaaaatataggttagcttgatgtctaaaaatatatttcatgtcttactgaaacattttgccagactttctccaaatgaaacctgaatcaatttttctaaatctaggtttcatagagtcctctcctctgcaatgtgttattctttctataatgatcagtttactttcagtggattcagaattgtgtagcaggataaccttgtatttttccatccgctaagtttagatggagtccaaacgcagtacagcagaagagttaacatttacacagtgctttttaccactgtggaatgttttcacactcatttttccttacaacaattctgaggagtaggtgttgttattatctccatttgatgggggtttaatgatttgctcaaagtcatttaggggtaataaatacttggcttggaaatttaacacagtccttttgtctccaaagcccttcttctttccaccacaaattaatcactatgtttataaggtagtatcagaatttttttaggattcacaactaatcactatagcacatgaccttgggattacatttttatggggcaggggtaagcggcttttaaatcatttgtgtgctctggctcttttgatagaagaaagcaacacaaaagctccaaagggccccctaaccctcttgtggctccagttatttggaaactatgatctgcatccttaggaatctgggatttgccagttgctggcaatgtagagcaggcatggaattttatatgctagtgagtcataatgatatgttagtgttaattagtttttcttcctttgattttattggccataattgctactcttcatacacagtatatcaaagagcttgataatttagttgtcaaaagtgcatcggcgacattatctttaattgtatgtatttggtgcttcttcagggattgaactcagtatctttcattaaaaaacacagcagttttccttgctttttatatgcagaatatcaaagtcatttctaatttagttgtcaaaaacatatacatattttaacattagtttttttgaaaactcttggttttgtttttttggaaatgagtgggccactaagccacactttcccttcatcctgcttaatccttccagcatgtctctgcactaataaacagctaaattcacataatcatcctatttactgaagcatggtcatgctggtttatagattttttacccatttctactctttttctctattggtggcactgtaaatactttccagtattaaattatccttttctaacactgtaggaactattttgaatgcatgtgactaagagcatgatttatagcacaacctttccaataatcccttaatcagatcacattttgataaaccctgggaacatctggctgcaggaatttcaatatgtagaaacgctgcctatggttttttgcccttactgttgagactgcaatatcctagaccctagttttatactagagttttatttttagcaatgcctattgcaagtgcaattatatactccagggaaattcaccacactgaatcgagcatttgtgtgtgtatgtgtgaagtatatctgggacttcagaagtgcaatgtatttttctcctgtgaaacctgaatctacaagttttctgccaagccactcaggtgcattgcagggaccagtgataatggctgatgaaaattgatgattggtcagtgaggtcaaaaggagccttgggattaataaacatgcactgagaagcaagaggaggagaaaaagatgtctttttcttccaggtgaactggaatttagttttgcctcagatttttttcccacaagatacagaagaagataaagatttttttggttgagagtgtgggtcttgcattacatcaaacagagttcaaattccacacagataagaggcaggatatataagcgccagtggtagttgggaggaataaaccattatttggatgcaggtggtttttgattgcaaatatgtgtgtgtcttcagtgattgtatgacagatgatgtattcttttgatgttaaaagattttaagtaagagtagatacattgtacccattttacattttcttattttaactacagtaatctacataaatatacctcagaaatcatttttggtgattattttttgttttgtagaattgcacttcagtttattttcttacaaataaccttacattttgtttaatggcttccaagagcctttttttttttgtatttcagagaaaattcaggtaccaggatgcaatggatttatttgattcaggggacctgtatttccatgtcaaatgttttcaaataaaatgaaatatgagtttcaatactttttatattttaatatttccttaatattatggttattgtccgccattttgttgtatattgtaaataaagtttagattgt

SEQ ID NO: 389 - DNA, 2414 bp, Homo sapiens
actctctttacagtcagccttctgcttgccacagtcatagtgggcagtcagtgaatcttccccaagtgctgacaattaatacctggtttagcggcaaagattcagagaggcgtgagcagcccctctggccttcagacaaaaatctacgtaccatcagaaactatgtctctgcagatggtaacagtcagtaataacatagccttaattcagccaggcttctcactgatgaattttgatggacaagttttcttctttggacaaaaaggctggcccaaaagatcctgccccactggagttttccatctggatgtaaagcataaccatgtcaaactgaagcctacaattttctctaaggattcctgctacctccctcctcttcgctacccagccacttgcacattcaaaggcagcttggagtctgaaaagcatcaatacatcatccatggagggaaaacaccaaacaatgaggtttcagataagatttatgtcatgtctattgtttgcaagaacaacaaaaaggttacttttcgctgcacagagaaagacttggtaggagatgttcctgaagccagatatggtcattccattaatgtggtgtacagccgagggaaaagtatgggtgctctctttggaggacgctcatacatgccttctacccacagaaccacagaaaaatggaatagtgtagctgactgcctgccctgtgttttcctggtggattttgaatttgggtgtgctacatcatacattcttccagaacttcaggatgggctatcttttcatgtctctattgccaaaaatgacaccatctatattttaggaggacattcacttgccaataatatccggcctgccaacctgtacagaataagggttgatcttcccctgggtagcccagctgtgaattgcacagtcttgccaggaggaatctctgtctccagtgcaatcctgactcaaactaacaatgatgaatttgttattgttggtggctatcagcttgaaaatcaaaaaagaatgatctgcaacatcatctctttagaggacaacaagatagaaattcgtgagatggagaccccagattggaccccagacattaagcacagcaagatatggtttggaagcaacacgggaaatggaactgtttttcttggcataccaggagacaataaacaagttgtttcagaaggattctatttctatatgttgaaatgtgctgaagatgatactaatgaagagcagacaacattcacaaacagtcaaacatcaacagaagatccaggggattccactccctttgaagactctgaagaattttgtttcagtgcagaagcaaatagttttgatggtgatgatgaatttgacacctataatgaagatgatgaagaagatgagtctgagacaggctactggattacatgctgccctacttgtgatgtggatatcaacacttgggtaccattctattcaactgagctcaacaaacccgccatgatctactgctctcatggggatgggcactgggtccatgctcagtgcatggatctggcagaacgcacactcatccatctgtcagcaggaagcaacaagtattactgcaatgagcatgtggagatagcaagagctctacacactccccaaagagtcctacccttaaaaaagcctccaatgaaatccctccgtaaaaaaggttctggaaaaatcttgactcctgccaagaaatcctttcttagaaggttgtttgattagttttgcaaaagcctttcagattcaggtgtatggaatttttgaatctatttttaaaatcataacattgattttaaaaatacatttttgtttatttaaaatgcctatgttttcttttagttacatgaattaagggccagaaaaaagtgtttataatgcaatgataaataaagtcattctagaccctatacattttgaaaatattttacccaaatactcaatttactaatttattcttcactgaggatttctgatctgattttttattcaacaaaccttaaacacccagaagcagtaataatcatcgaggtatgtttatatttattatatgagtcttggtaacaaataacctataaagtgtttatgacaaatttagccaataaagaaattaacacccaaaagaattaaattgattattttgtgcaacataacaattcggcagttggccaaaacttaaaagcaagatctactacatcccacattagtgttctttatataccttcaagcaaccctttggattatgcccatgaacaagttagtttctcatagctttacagatgtagatataaatataaatatatgtatacatatagatagataatgttctccactgacacaaaagaagaaataaataatctacatcaaaaaaaaaaaaaaaaaaaaaaaaaaaa

SEQ ID NO: 390 - DNA, 3524 bp, Homo sapiens
tctccgtcagccgcattgcccgctcggcgtccggcccccgacccgtgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtgtggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttcccctcccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcgtgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtatgtgctgtggtgtgtccccctctgtccaggcactgagataccagcgaggaggctccagagggcactctgcttgttattagagattacctcctgagaaaaaagcttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaagtgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgta

SEQ ID NO: 391 - DNA, 1084 bp, Homo sapiens
cgaggatgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggcaacgggatggtgagccgctgcagccgctcccagaacacggtgtgccgtccgtgcgggccgggcttctacaacgacgtggtcagctccaagccgtgcaagccctgcacgtggtgtaacctcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcccatcactgtccagcccactgaagcctggcccagaacctcacagggaccctccacccggcccgtggaggtccccgggggccgtgcggttgccgccatcctgggcctgggcctggtgctggggctgctgggccccctggccatcctgctggccctgtacctgctccggagggaccagaggctgccccccgatgcccacaagccccctgggggaggcagtttccggacccccatccaagaggagcaggccgacgcccactccaccctggccaagatctgacctgggcccaccaaggtggacgctgggccccgccaggctggagcccggagggtctgctgggcgagcagggcaggtgcaggccgcctgccccgccacgctcctgggccaactctgcaccgttctaggtgccgatggctgcctccggctctctgcttacgtatgccatgcatacctcctgccccgcgggaccacaataaaaaccttggcagacgggagtctccgaccggcaaaaaaaaaaaaaaaaa

SEQ ID NO: 392 - DNA, 3510 bp, Homo sapiens
tcaatcgccttttatctctggccctgggacctttgcctattttctgattgataggctttgttttgtctttacctccttctttctggggaaaacttcagttttatcgcacgttccccttttccatatcttcatcttccctctacccagattgtgaagatggaaagggtccaacccctggaagagaatgtgggaaatgcagccaggccaagattcgagaggaacaagctattgctggtggcctctgtaattcagggactggggctgctcctgtgcttcacctacatctgcctgcacttctctgctcttcaggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcaggacttgaagagagccgtctaagaaataccacgtgctttttttctttaccattttgctttcccagcctccaaacatagttaatagaaatttcccttcaaagaactgtctggggatgtgatgctttgaaaaatctaatcagtgacttaagagagattttcttgtatacagggagagtgagataacttattgtgaagggttagctttactgtacaggatagcagggaactggacatctcagggtaaaagtcagtacggattttaatagcctggggaggaaaacacattctttgccacagacaggcaaagcaacacatgctcatcctcctgcctatgctgagatacgcactcagctccatgtcttgtacacacagaaacattgctggtttcaagaaatgaggtgatcctattatcaaattcaatctgatgtcaaatagcactaagaagttattgtgccttatgaaaaataatgatctctgtctagaaataccatagaccatatatagtctcacattgataattgaaactagaagggtctaatatcagcctatgccagggcttcaatggaatagtatccccttatgtttagttgaaatgtccccttaacttgatataatgtgttatgcttatggcgctgtggacaatctgatttttcatgtcaactttccagatgatttgtaacttctctgtgccaaaccttttataaacataaatttttgagatatgtattttaaaattgtagcacatgtttccctgacattttcaatagaggatacaacatcacagaatctttctggatgattctgtgttatcaaggaattgtactgtgctacaattatctctagaatctccagaaaggtggagggctgttcgcccttacactaaatggtctcagttggatttttttttcctgttttctatttcctcttaagtacaccttcaactatattcccatccctctattttaatctgttatgaaggaaggtaaataaaaatgctaaatagaagaaattgtaggtaaggtaagaggaatcaagttctgagtggctgccaaggcactcacagaatcataatcatggctaaatatttatggagggcctactgtggaccaggcactgggctaaatacttacatttacaagaatcattctgagacagatattcaatgatatctggcttcactactcagaagattgtgtgtgtgtttgtgtgtgtgtgtgtgtgtgtatttcactttttgttattgaccatgttctgcaaaattgcagttactcagtgagtgatatccgaaaaagtaaacgtttatgactataggtaatatttaagaaaatgcatggttcatttttaagtttggaatttttatctatatttctcacagatgtgcagtgcacatgcaggcctaagtatatgttgtgtgtgttgtttgtctttgatgtcatggtcccctctcttaggtgctcactcgctttgggtgcacctggcctgctcttcccatgttggcctctgcaaccacacagggatatttctgctatgcaccagcctcactccaccttccttccatcaaaaatatgtgtgtgtgtctcagtccctgtaagtcatgtccttcacagggagaattaacccttcgatatacatggcagagttttgtgggaaaagaattgaatgaaaagtcaggagatcagaattttaaatttgacttagccactaactagccatgtaaccttgggaaagtcatttcccatttctgggtcttgcttttctttctgttaaatgagaggaatgttaaatatctaacagtttagaatcttatgcttacagtgttatctgtgaatgcacatattaaatgtctatgttcttgttgctatgagtcaaggagtgtaaccttctcctttactatgttgaatgtatttttttctggacaagcttacatcttcctcagccatctttgtgagtccttcaagagcagttatcaattgttagttagatattttctatttagagaatgcttaagggattccaatcccgatccaaatcataatttgttcttaagtatactgggcaggtcccctattttaagtcataattttgtatttagtgctttcctggctctcagagagtattaatattgatattaataatatagttaatagtaatattgctatttacatggaaacaaataaaagatctcagaattcactaaaaaaaaaaaaaaaaaa

SEQ ID NO: 393 - DNA, 1158 bp, Homo sapiens
ggaattccgtggccaggatgctgagcctgctgctgctggcgctgcccgtcctggcgagccgcgcctacgcggcccctgccccagtccaggccctgcagcaagcgggtatcgtcgggggtcaggaggcccccaggagcaagtggccctggcaggtgagcctgagagtccgcgaccgatactggatgcacttctgcgggggctccctcatccacccccagtgggtgctgaccgcggcgcactgcctgggaccggacgtcaaggatctggccaccctcagggtgcaactgcgggagcagcacctctactaccaggaccagctgctgccagtcagcaggatcatcgtgcacccacagttctacatcatccagactggagcggatatcgccctgctggagctggaggagcccgtgaacatctccagccgcgtccacacggtcatgctgccccctgcctcggagaccttccccccggggatgccgtgctgggtcactggctggggcgatgtggacaatgatgagcccctcccaccgccatttcccctgaagcaggtgaaggtccccataatggaaaaccacatttgtgacgcaaaataccaccttggcgcctacacgggagacgacgtccgcatcatccgtgacgacatgctgtgtgccgggaacagccagagggactcctgcaagggcgactctggagggcccctggtgtgcaaggtgaatggcacctggctacaggcgggcgtggtcagctgggacgagggctgtgcccagcccaaccggcctggcatctacacccgtgtcacctactacttggactggatccaccactatgtccccaaaaagccgtgagtcaggcctgggtgtgccacctgggtcactggaggaccaacccctgctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcactgggccctccggccctcccctgcccaggcagctggtggtgggcgctaatcctcctgagtgctggacctcattaaagtgcatggaaatc

SEQ ID NO: 394 - DNA, 1497 bp, Homo sapiens
accgctggccccagggaaagccgagcggccaccgagccggcagagacccaccgagcggcggcggagggagcagcgccggggcgcacgagggcaccatggcccagacgcccgccttcgacaagcccaaagtagaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaaatttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaactaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggcagggaccagcgcccttgcacatgggcatggttgaatctgaaaccctccttctgtggcaacttgtactgaaaatctggtgctcaataaagaagcccatggctggtggcatgc

SEQ ID NO: 395 - DNA, 2085 bp, Homo sapiens
gcatttcttccttctgcgtatgggacaggaccctttctggaatgggggtcttatgacctacaatcaaacaagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatattataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaatgcctgcaaaaagaagatcattttgtatacagagaaccggatgaatataagcaatgaagatgaacatttattgatcttctacatacaagacttcaccataaggccaggagcagtgctcacgccttgtaatcccagcactttgggaggccaaggtgggcggatcaccttgaggtcaggagttcaagaccagcctgaccaacatggtgaaaccctgtctctactaaatattagcggggtgtggtggcgggcacctgtagtcgcagcctttcgggaggctgagacaggagaatcgcttgaaccctagaggcggagtttgcagtgagccgagatagtgccattgtactccagcttgggcaacagagtaagactctgtctc

SEQ ID NO: 396 - DNA, 781 bp, Homo sapiens
acacagagagaaaggctaaagttctctggaggatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgagaccggccagatgaggctggccaagccggggagctgctctctcatgaaacaagagctagaaactcaggatggtcatcttggagggaccaaggggtgggccacagccatggtgggagtggcctggacctgccctgggccacactgaccctgatacaggcatggcagaagaatgggaatattttatactgacagaaatcagtaatatttatatatttatatttttaaaatatttatttatttatttatttaagttcatattccatatttattcaagatgttttaccgtaataattattattaaaaatatgcttcta

SEQ ID NO: 397 - DNA, 1509 bp, Homo sapiens
aaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctcca

SEQ ID NO: 398 - DNA, 1631 bp, Homo sapiens
ggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccggggtacagtattttctcgtatgccaccaagagacaagacaatgagattcttcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagcattgcccacattcacagggctcttcagtatcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaacacaggtgccgtg

SEQ ID NO: 399 - DNA, 3475 bp, Homo sapiens
cgaggcggcatccgagggctgggccggcgccctgggggaccccgggctccggaggccatgccggcgttggcgcgcgacgcgggcaccgtgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgatgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtaggaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagccgtctgcgtttactcttgttttcaaagggacttttgtaaaatcaaatcatcctgtcacaaggcaggaggagctgataatgaactttattggagcattgatctgcatccaaggccttctcaggccggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacag

SEQ ID NO: 400 - DNA, 2365 bp, Homo sapiens
tcccagccttcccatccccccaccgaaagcaaatcattcaacgacccccgaccctccgacggcaggagccccccgacctcccaggcggaccgcccttccctccccgcgcgggttccgggcccggcgagagggcgcgacgacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaaatcctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggccctctgcaaaggaaataccagttctgggcaatcagtgttaccgttcaccagttgccattgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaattttcggttgaataaactagattacattcagttggcaaaaaaaaaaaaa

SEQ ID NO: 401 - DNA, 1658 bp, Homo sapiens
ctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcattcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcatgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcgtcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctattt

SEQ ID NO: 402 - DNA, 1152 bp, Homo sapiens
tcagagttcacgaggcagccgaggaagaggaggcttgaggcccagggtgggcaccagccagccatggccacagccgagaccgccttgccctccatcagcacactgaccgccctgggccccttcccggacacacaggatgacttcctcaagtggtggcgctccgaagaggcgcaggacatgggcccgggtcctcctgaccccacggagccgcccctccacgtgaagtctgaggaccagcccggggaggaagaggacgatgagaggggcgcggacgccacctgggacctggatctcctcctcaccaacttctcgggcccggagcccggtggcgcgccccagacctgcgctctggcgcccagcgaggcctccggggcgcaatatccgccgccgcccgagactctgggcgcatatgctggcggcccggggctggtggctgggcttttgggttcggaggatcactcgggttgggtgcgccctgccctgcgagcccgggctcccgacgccttcgtgggcccagccctggctccagccccggcccccgagcccaaggcgctggcgctgcaaccggtgtacccggggcccggcgccggctcctcgggtggctacttcccgcggaccgggctttcagtgcctgcggcgtcgggcgccccctacgggctactgtccgggtaccccgcgatgtacccggcgcctcagtaccaagggcacttccagctcttccgcgggctccagggacccgcgcccggtcccgccacgtccccctccttcctgagttgtttgggacccgggacggtgggcactggactcggggggactgcagaggatccaggtgtgatagccgagaccgcgccatccaagcgaggccgacgttcgtgggcgcgcaagaggcaggcagcgcacacgtgcgcgcacccgggttgcggcaagagctacaccaagagctcccacctgaaggcgcatctgcgcacgcacacaggggagaagccatacgcctgcacgtgggaaggctgcggctggagattcgcgcgctcggacgagctgacccgccactaccggaaacacacggggcagcgccccttccgctgccagctctgcccacgtgctttttcgcgctctgaccacctggccttgcacatgaagcgccacctttga

SEQ ID NO: 403 - DNA, 2032 bp, Homo sapiens
cgcctggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaaccactccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgccgggtccttttcactgtcggtccgggacttcgaccaaaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtgcatgtgtagcctgtgcatgtatgtcttggacactgtacaaggtacccctttctggctctcccatttcctgagaccaccagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgccg

SEQ ID NO: 404 - DNA, 3084 bp, Homo sapiens
aagatctaaaaacggacatctccaccgtgggtggctcctttttctttttctttttttcccacccttcaggaagtggacgtttcgttatcttctgatccttgcaccttcttttggggaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgacgccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagctatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaaccccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaagcacagcctttgcccaaaactgtcatcctaacgtttgtcattccagtttgagttaatgtgctgagcatttttttaaaagaagctttgtaataaaacatttttaaaaattgtcatttaaaaaaaaaaaaaaaaaa

SEQ ID NO: 405 - DNA, 1743 bp, Homo sapiens
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaaggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggcaatgggagagctcttgttattattaatattgttgccgctgttgtgttgttgttattaattaatattcatattatttattttatacttacataaagattttgtaccagtgg

SEQ ID NO: 406 - DNA, 1204 bp, Homo sapiens
gaaattcttacaaaaactgaaagtgaaatgaggaagacagattgagcaatccaatcggagggtaaatgccagcaaacctactgtacagtaggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaatacca

SEQ ID NO: 407 - DNA, 1666 bp, Homo sapiens
ctccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 408 - DNA, 960 bp, Homo sapiens
agcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacaagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctctcccagtgtaaatctggagccaagtccagatttacactgggagaggtgccagcaactgaataaatacctcttagctgagtgg

SEQ ID NO: 409 - DNA, 1909 bp, Homo sapiens
gaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagagtctaccagccagatgcacacagcatcatctttggagaagcaaataggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaaaaaaaaaaaaaaaaaaaaaaaaaaaaaaaaaaaaaaaaaaaaaaaaaaaa

SEQ ID NO: 410 - DNA, 2700 bp, Homo sapiens
gcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaactttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcagtgaaaaaaaaaaaaaaaaaaaa

SEQ ID NO: 411 - DNA, 1668 bp, Homo sapiens
atggcagcccgtctgctcctcctgggcatccttctcctgctgctgcccctgcccgtccctgccccgtgccacacagccgcacgctcagagtgcaagcgcagccacaagttcgtgcctggtgcatggctggccggggagggtgtggacgtgaccagcctccgccgctcgggctccttcccagtggacacacaaaggttcctgcggcccgacggcacctgcaccctctgtgaaaatgccctacaggagggcaccctccagcgcctgcctctggcgctcaccaactggcgggcccagggctctggctgccagcgccatgtaaccagggccaaagtcagctccactgaagctgtggcccgggatgcggctcgtagcatccgcaacgactggaaggtcgggctggacgtgactcctaagcccaccagcaatgtgcatgtgtctgtggccggctcacactcacaggcagccaactttgcagcccagaagacccaccaggaccagtacagcttcagcactgacacggtggagtgccgcttctacagtttccatgtggtacacactcccccgctgcaccctgacttcaagagggccctcggggacctgccccaccacttcaacgcctccacccagcccgcctacctcaggcttatctccaactacggcacccacttcatccgggctgtggagctgggtggccgcatatcggccctcactgccctgcgcacctgcgagctggccctggaagggctcacggacaacgaggtggaggactgcctgactgtcgaggcccaggtcaacataggcatccacggcagcatctctgccgaagccaaggcctgtgaggagaagaagaagaagcacaagatgacggcctccttccaccaaacctaccgggagcgccactcggaagtggttggcggccatcacacctccattaacgacctgctgttcgggatccaggccgggcccgagcagtactcagcctgggtaaactccgtgcccggcagccctggcctggtggactacaccctggaacccctgcacgtgctgctggacagccaggacccgcggcgggaggcactgaggagggccctgagtcagtacctgacggacagggctcgctggagggactgcagccggccgtgcccaccagggcggcagaagagcccccgagacccatgccagtgtgtgtgccatggctcagcggtcaccacccaggactgctgccctcggcagaggggcctggcccagctggaggtgaccttcatccaagcatggagcctgtggggggactggttcactgccacggatgcctatgtgaagctcttctttggtggccaggagctgaggacgagcaccgtgtgggacaataacaaccccatctggtcagtgcggctggattttggggatgtgctcctggccacaggggggcccctgaggttgcaggtctgggatcaggactctggcagggacgatgacctccttggcacctgtgatcaggctcccaagtctggttcccatgaggtgagatgcaacctgaatcatggccacctaaaattccgctatcatgccaggtgcttgccccacctgggaggaggcacctgcctggactatgtcccccaaatgcttctgggggagcctccaggaaaccggagtggggccgtgtggtga

SEQ ID NO: 412 - DNA, 921 bp, Homo sapiens
ttctatgcaaagcaaaaagccagcagcagccccaagctgataagattaatctaaagagcaaattatggtgtaatttcctatgctgaaactttgtagttaattttttaaaaaggtttcattttcctattggtctgatttcacaggaacattttacctgtttgtgaggcattttttctcctggaagagaggtgctgattggccccaagtgactgacaatctggtgtaacgaaaatttccaatgtaaactcattttccctcggtttcagcaattttaaatctatatatagagatatctttgtcagcattgcatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaagactctgtgcaccgagttgaccgtaacagacatctttgctgcctccaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatct

SEQ ID NO: 413 - DNA, 1282 bp, Homo sapiens
aagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacagttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctagcacttggagccaagggttcagagactcagggccccagcactaaagcagtggacaccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttccttgtatttaaatattaaatatgttagcaaagagttaatatatagaagggtaccttgaacactgggggaggggacattgaacaagttgtttcattgactatcaaactgaagccagaaataaagttggtgacagat

SEQ ID NO: 414 - DNA, 2025 bp, Homo sapiens
cttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttaaaaaaaaaaaaaaaaaaaaaaaaaaaaaaaaaaaaaaaaaaaaaaaaaaaaaaaaaa

SEQ ID NO: 415 - DNA, 2261 bp, Homo sapiens
gaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 416 - DNA, 1425 bp, Homo sapiens
cagtctgagaacaagaaagaagaacttctgtctcgagggtctcactgtcaaccaggccagagtgcagtgaagatcatacctcactacatccgtgaactcccgggctcctcccacctaagtctcttgagtagctgggacttcaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaagcctgtccaaaagaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagt

SEQ ID NO: 417 - DNA, 292 bp, Homo sapiens
tcttcaacaaggggtaaatcagtcagtttctaaaactggtgggaggtctccataaacctgataacaagatcccaaactccaaactgattgactgagttaattcctgatcatttgggttgaacttaagagttatacaagaaaatggtaggggacgaggaggttgtataaaggggaaaaaacaacaactgcaaaaagcccaagagcctgaatttagaccaatctatcatcttcctcctcttaaaaagaaaacaatttaaaagtttcaaaaaaaaaaaaaaaaaaaaaaaaaaaa

SEQ ID NO: 418 - DNA, 626 bp, Homo sapiens; identical to SEQ ID NO: 368

SEQ ID NO: 419 - DNA, 1764 bp, Homo sapiens
cgtctggttcaggggctagaaaagagcgtcgatgccggcggcagtgatgagtcctaggaggcgctggctctttggcggctcggaggagcggctgctgctgctgctgctgctgctggtggcccctttgcagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcaaaaaaaaaaaaaaaaa

SEQ ID NO: 420 - DNA, 2154 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccagaccttttgagttcaactgatcaaaccaaaggaaaagtgttgctagagaaaattggggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtatggta

SEQ ID NO: 421 - DNA, 2960 bp, Homo sapiens
ggcacgagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccaggcccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgt

SEQ ID NO: 422 - DNA, 456 bp, Homo sapiens
gcacgagtggagttgggtgtcggcttttttagccagcttttgtgggaattgcctttgacctattaaagaaggaaagtgggtaatggagtcccagccactcaagagactggatatcccccgagaatggcttgggttaccagctatggacccttggaagatgaatctaatccttctcactggtttttctttgcaaattcatttgcttttatttttctaataacaataaactctattttccatgttctcagggcccctgggtagacagacacagcttgatttcagagcagacataggcgaagaaaacatggcattgagtgtgctgagtccagacaaatgttatttatatacacatccaaatttgaagagaaaatgtatttctttaggtttcaaacactgtaatagatataaagcaaaaataaaaacctgttgcaaagttaaaaaaaaaaaaaaaaaaaa

SEQ ID NO: 423 - DNA, 691 bp, Homo sapiens
  misc_feature (35)..(35): n is a, c, g, t or u
  misc_feature (140)..(140): n is a, c, g, t or u
  misc_feature (394)..(394): n is a, c, g, t or u
  misc_feature (397)..(397): n is a, c, g, t or u
  misc_feature (401)..(401): n is a, c, g, t or u
  misc_feature (404)..(404): n is a, c, g, t or u
  misc_feature (412)..(412): n is a, c, g, t or u
  misc_feature (536)..(536): n is a, c, g, t or u
  misc_feature (569)..(569): n is a, c, g, t or u
  misc_feature (581)..(581): n is a, c, g, t or u
  misc_feature (615)..(615): n is a, c, g, t or u
  misc_feature (619)..(619): n is a, c, g, t or u
  misc_feature (640)..(640): n is a, c, g, t or u
  misc_feature (651)..(651): n is a, c, g, t or u
  misc_feature (662)..(662): n is a, c, g, t or u
  misc_feature (677)..(677): n is a, c, g, t or u
  misc_feature (680)..(680): n is a, c, g, t or u
  misc_feature (687)..(687): n is a, c, g, t or u
ttttttttttttttttttttttttttttttttttncaaaatataaactttattattttacattcaagtgaaacttccatctggaggggctaaacacagctgccggccacattcactgatttattactttgttgccttttncgttcacctgatggaagaattcaaccctcttaaaaacataacaacaacaaaaacagctggagagtcccagccgtaatactaggtgtagacacgcacaagcacacacacaaattcaaaaacttctacatagaaaaataaaggataaacattatccatctattttgtactgtgtaatgcaacttttatatacataaatttttttttttttttttttttttttttttttttaactgttttcagtcactgcaaatttnctncccnccnctgggatntaaggatccagggaggaggctgccacagtgaaacaaaaaagctacattctgcccagggaggaaaaaaaaaagcaatttctcgctccccttcccaagtccttcctgtccaccaccacctcggatnttcccgcacacagccttccggtgagcgggcgtnccgtcccctccnctctctaaggcattggggaacaaaaggcccatangcancccctgccaaaaaaaaaaatnatctacctttnaagaaaaggcnaggggctgggatccngcnaaaaatnactt

SEQ ID NO: 424 - DNA, 1705 bp, Homo sapiens
ccagccctgagattcccacgtgtttccattcagtgatcagcactgaacacagaggactcgccatggagtttgggctgagctgggttttccttgttgctattttaaaaggtgtccagtgtgaggtgcagttggtggagtctgggggaggtgtggtacggcctggggggtccctgagactctcctgtgcaacctctggattcacctttgatgattccggcgcgagctgggtccgccaagctccagggaagggactggagtgggtctctagtattaattggaatggtggtagcacaaattatgcagactctgtgaagggccgattcaccatctccagagacaacgccaagaactccctatatctacaaatgaacagtctgagagtcgaggacacggccttgtattactgtgcgagagacccgactaaatattgtagtggtggcagctgcctggggtactacatggacgtctggggcaaggggaccacggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 425 - DNA, 4498 bp, Homo sapiens
gagggctctgacagacacaagtcaccttcttattgcacttagctctccctggggacttaaattttggcagtgttcctctttacatgatatcctccaagatgatgagttctaatcctgaggaagaccctttggacacatttctccagtacattgaggatatggggatgaaggcctacgatggcttggttattcagaatgcgtcagatattgctcgagagaatgatcgcttgagaaatgaaactaacctagcctatttgaaagagaagaatgaaaaacgccgaagacaagaagaagcaataaagcgcataggtggagaagtagggcgaggccacgaaggaagttacgtgggcaaacatttccgcatgggattcatgacaatgcctgctcctcaggacagacttccccatccttgctccagtggcttttctgtgagatcacagtccctgcactcggttgggggcacagacgatgacagcagctgtggctcacggagacaaccaccacccaaacccaagagggaccccagcaccaagctgagcacctcatcagagacagtcagcagcactgcagccagtaagagcgggaaaacccctgagaggactgaagcgtcagctaaaccaagaccccacagcgatgaatattccaagaagattcctcctcccaaaccgaagcgaaatccgaacactcagctgagcacatctttcgatgaaacgtacatcaaaaagcatgggccccggaggacgtcgctgccgcgggactcctccttgtcccagatgggcagccccgcgggagaccccgaggaagaggagcccgtgtacatcgagatggtggggaacattctcagagacttcaggaaggaggacgatgaccagagcgaggccgtctacgaggaaatgaagtaccctatctttgacgacttgggccaagacgccaaatgtgacttcgaccatcacagctgttcttcgcagtgtgctactcccacggtgcctgacttggacttcgccaaggcctcagtgccatgcccccccaaggggctgctttgcgacatccctccgcccttccccaacctgctttctcacagacccccgctgctggtatttccccccgcccccgtgcattgctcccccaactccgacgagtccccgcttacccctctggaggtcacgaagcttcccgtgctggaaaacgtgtcttacatgaaacagccagccggggcgtcgccctccacgctgccgtcccacgtccccggccatgcgaaactggagaaagagcaggccgcggccctgggacctgcctctgccacccctgcgctctcctcgtcgcccccacccccgtctacgctgtaccgaacccagtctccccatggctaccctaaaagtcactccacctctccctcccccgtcagcatggggaggtccctgactcccctgagcctcaaaaggcctcccccttacgacgctgtgcattcgggcagcctctcaaggagctctccttcagtgcctcactcgacccccagacccgtgtcgcaagatggggccaagatggtcaacgccgcggtgaacacctacggggcagccccgggtggctcccggtcccggacacccacgagcccgctggaggagctgaccagcctcttctcctccggccgcagcctgctgcgcaagtcgtccagtggccggcgctccaaagagcctgcagagaaatcaacagaggaactgaaagtccgaagccacagcacggagccattaccaaagttggacaacaaggaaagaggccaccatggggcgtcttcctccagagagcctgtcaaagctcaggaatgggatggaacaccagggccacctgtggtcaccagtcgactaggaagatgctctgtgagccccaccttgttagcgggaaaccacagttcagagcctaaagtaagctgcaaattaggccggtctgcgtcgacgtcaggtgtgcctcctccatcagtcactcccctcaggcaaagcagtgacctgcaacagagccaggtaccatcatcgttagccaatcgtgattgacttcctgtgatacaacttgccaaatgcttcccacctctgtctgtcctgttgctgtagacaactttcgcatttgcttttatttttctatgtgtgtatgggttaggggatgcgggggatgagttctggcagtctgtgttttcatttgaaaaagaatatctttcttccttgtgattggtggtgaaactttctttgctgtttgttaccaaatcgtttttgtctctggtttccatcattctgtaatataaatgtagtaaacttgtactatatgtattggcttagtggttcttttttaaattctttctctctttcatgttttgtgtacttttatactgtctctgaaaatttatcaatatttgataaatttatctactttgttttatgtagatttctttttaaatgttttgtccagaacactcgcacagatgttgtcaatgaatttgtacatatttcttagctcttatcctattatactgtaatatttctggtggttttatttttatttagcttggagcatgactgtaagacactgttgaatattgatgtccttataaatattcatatcccgattcatttggattgagtatggcagctagtctttcttctttcttaggctattgactggcctaagacagtttgactggccagacaaattgactggccagataatctagatatttaacaaaaactgcagattaataaggcaacctttaaatgaatgacttttctctcttataccaacaatatcagaaatgttctcagaaagggaatgtaagtgttcatgcatggtaaatgagatctcaattatcacttggagaaaagagacaagaaataaaggcataaactgaaatatcatttaatcctttacagcataatatgttgctctgatgttcgtttgggtacatggttgtggatggggaattagtatggggaaaaatcactacacataaatgtcctacctttagctcacccaataggaattcaatacattgacttaatttgtgaggcttaattgtcgttactgttaagtattataggtgttaagtagggtggtgtcattctggaatgttttctctctgcttcctagcttcaatctttgcattcatgaaactcttctgaaatagcaacttataaaacactgatgatacctccaagggaactgcccattactgatgagaaaattacatattcatctattattttaaatgtcaggctattttaaaaacataactaagtagaataattgcgttttcttctaatgagagacattgtgcctcttagtgtttttgtctgacttaaatatgcaaaatagttgatttataaatatatgaggtatctgcaaatacaagaaatgagaggcttctctcaagggtatctcaagtaccatttagaatttcttgtgtcttaatttaaaatttaaatgcctttatataaatgttaaatgcctttataactaaatgtaccaactcaaacactttttggatataaaagaagtagaaacagtaagacactgaataaaataaataagataaactgccaacttagctaattaaagctattccaaaaatattgtacttaccaacatttaaagcttaaaaacattgggtactgaaagaagagaagtttagctaattggcagaggattgcactaatacaatcaagttttcaagtttatgacccttgctagtatattaccttcaatatctcagagatgttttgtattatttgttttgttttgcttttttcctagttgtctttatagctgtttcaccctaagccccttcaaactctcaatgaaagcaggttcttgggataaacttccagaatagagacaaggtataccctttgtgcctttgcattatcaactctttgttcacctgatgggaagttcttcgtttttcaaaatgtagcaagggagaaagcccaggacgcctttatatgctgttagtttccttacctgctgatagagattctgacacacagtcaaatcatacatgggctgtcagagctataaattagaaggctggcctctaggcttctcctctgtggcttatagccagttgtaatatacatgcattcctatactctagagatgaagtggtaagcatagctcatatgaacactgctctgaactcctctgacttagcattcaacttaagtcaagaaatacttattggctgggcgtggtggctcacgcctgtaatcccagcactctgggaggcagaggtgggtggatcacaaggtcaggagattgagaccatcctggctaacacggtgagaccccatctctactaaaaatacaaaaaattagccaggtgtggtggcgggcgcctgtagtcccagctacttgggaggctgaggcaggagaatgtggtgaacctgggaggtggagcttgcagtgagctgagatcgcaccactgcactccagcctgggtgacagagcgagactccatctc

SEQ ID NO: 426 - DNA, 3478 bp, Homo sapiens
attttccgggccgggcgcactaaggtgcgcggccccggggcccagtatatgacccgccgtcctgctatccttcgcttcccccgccccatgtggctgcggggccgcggcggcgctgcccactatggcccggaaagtagttagcaggaagcggaaagcgcccgcctcgccgggagctgggagcgacgctcagggcccgcagttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgcatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttccttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccgtggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttccggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagactttctgtttttaaaaatgtagcacttgactttttgccaggaaaaaaataaaaattattccgtgcaaaaaaaaaaaaaaaaaaaaaaaaaaaaaaaaa

SEQ ID NO: 427 - DNA, 584 bp, Homo sapiens
atttggccctcgaggccaagaattcggcacgaggcgctcagtttcagcagccagataatggctatatttatctaacatcttgagttcaaaagcatgacggcgcattttggggcactgaacaacatcaatgcaggcgtccaagtagatgcaacctttcgattcttttgaatttttctcatctttataggaattgagaatatatgaaccgtcaggaagttgggtcaagtaaaaatatcgtctcttgaataccttcatggttactgtgatggtactatttacatttgctttatgcaaccagccttgttttatcacaccacccttctgagaacataaagaagatgagtcctcatctttctcacagtcttcatctatctcaaatacatgattaggaatcttttctggtctcaaagatttacatggcaacattcgaaagtccccagagaagtcctcatacttgtagtttaccacgtgccaatctgtgctataggttttaatacactctttaacaaataaactctgggccctcttttcagcatcttctggtacagtaaaactgaaccgttctgggttgacgacctataacc

SEQ ID NO: 428 - DNA, 1679 bp, Homo sapiens
gtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttacttagtgttatg

SEQ ID NO: 429 - DNA, 1702 bp, Homo sapiens
agactcaacaagagctccagcaaagactttcactgtagcttgacttgacctgagattaactagggaatcttgagaataaagatgagctctgaaaattgtttcgtagcagagaacagctctttgcatccggagagtggacaagaaaatgatgccaccagtccccatttctcaacacgtcatgaagggtccttccaagttcctgtcctgtgtgctgtaatgaatgtggtcttcatcaccattttaatcatagctctcattgccttatcagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatgaactttctaaaacgatacgcaggtagagaggaacactgggttggactgaaaaaggaacctggtcacccatggaagtggtcaaatggcaaagaatttaacaactggttcaacgttacagggtctgacaagtgtgtttttctgaaaaacacagaggtcagcagcatggaatgtgagaagaatttatactggatatgtaacaaaccttacaaataataaggaaacatgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggttgaccaataaccatgcccaagaatgagaagaatgactatgcaacctttggatgcactttatattattttgaatccagaaataatgaaataactaggcgtggacttactatttattgctgaatgactaccaacagtgagagcccttcatgcatttgcactactggaaggagttagatgttggtactagatactgaatgtaaacaaaggaattatggctggtaacataggtttttagtctaattgaatcccttaaactcagggagcatttataaatggacaaatgcttatgaaactaagatttgtaatatttctctctttttagagaaatttgccaatttactttgttatttttccccaaaaagaatgggatgatcgtgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaacacaaaaaaaaaaaaaaaaaaaaaaaaaaaa

SEQ ID NO: 430 - DNA, 1237 bp, Homo sapiens
gctgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaatacaaaaattagccgggcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcggcttaccattaaagttctcaatgcaaccataaaaaaaaaa

SEQ ID NO: 431 - DNA, 1125 bp, Homo sapiens
ttctgccctcgagcccaccgggaacgaaagagaagctctatctcgcctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattc

SEQ ID NO: 432 - DNA, 1047 bp, Homo sapiens
cgaattcccctatcacctaagtgtgggctaatgtaacaaagagggatttcacctacatccattcagtcagtctttgggggtttaaagaaattccaaagagtcatcagaagaggaaaaatgaaggtaatgttttttcagacaggtaaagtctttgaaaatatgtgtaatatgtaaaacattttgacacccccataatatttttccagaattaacagtataaattgcatctcttgttcaagagttccctatcactctctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgataattaagtgcttcccacttaaaacatatcaggccttctatttatttaaatatttaaattttatatttattgttgaatgtatggtttgctacctattgtaactattattcttaatcttaaaactataaatatggatcttttatgattctttttgtaagccctaggggctctaaaatggtttcacttatttatcccaaaatatttattattatgttgaatgttaaatatagtatctatgtagattggttagtaaaactatttaataaatttgataaatataaaaaaaaaaaa

SEQ ID NO: 433 - DNA, 1242 bp, Homo sapiens
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacagtactatgccaatcagaatggctcaaataccaagggaagtgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaaaaa

SEQ ID NO: 434 - DNA, 2298 bp, Homo sapiens
tcggccgagcccagagacagccagttcctctcccgccgcgccgggccgcgtgccgctcgctccccggccgtggcgcctccgggccagacgcgctgcagcctccagcccgcggcaagcgggcggggcggccgcgccacccccggccccgcgccagcagcccctcgccgcgcgtccagcgttcccggccagcagcctccccatacgcagtcctgctggaccgccccgtcgcgccccccactctgaactcaagtcaccgtggagctccgccgccccgaaactttcacgcgagcgggaaatatgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactaatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgttt

SEQ ID NO: 435 - DNA, 2308 bp, Homo sapiens
gagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagg

SEQ ID NO: 436 - DNA, 696 bp, Homo sapiens
ttccccccccccccccccccccccgcccgagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcctatggggatggtccactgtcactgtttctctgctgttgcaaatacatggataacacatttgattctgtgtgttttccataataaaactttaaaataaaatgcagacagtta

SEQ ID NO: 437 - DNA, 116 bp, Homo sapiens
gatcagatttgggtgggagaaagaagtgggtatcaagggtgatttgaattttctgcagcattaaagtggcgttaataagataagtaataataaagaattctaacatccatgtcaaa

SEQ ID NO: 438 - DNA, 3426 bp, Homo sapiens
gagcaatgatgtagccacctcctaaccttcccttcttgaacccccaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtgatctagcccagggaagcccttccgtgggggccccggctttgagggatgccaccggttctggacgcatggctgattctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacaatcctgcagagaacagccccaatcaccgtccttacacggcctctgatttcatagaagggatctaccgaacagaaagggacaaagggacattgtatgagctcaccttcaaaggggaccacaaacatgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaatacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaatatatatatatatatatatattgtgaaagatcaatccatctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaagctcattgtttaaaagcttc

SEQ ID NO: 439 - DNA, 384 bp, Homo sapiens
  misc_feature (144)..(145): n is a, c, g, t or u
  misc_feature (159)..(159): n is a, c, g, t or u
  misc_feature (165)..(165): n is a, c, g, t or u
  misc_feature (223)..(223): n is a, c, g, t or u
  misc_feature (309)..(309): n is a, c, g, t or u
tttttttttttttttttttttcgaagatcagtactttattttctctagctccagtgttttgcaactgtagcagcatatcagaaacatccccacacaaaaacacacaattctccccttcttcaaagagctggcaacaattgaganncagaaacaatagtnactacnggcatttgagaaatttaagaaataacacttgctcacccttgaaacatacattgtgcgncttgcaggtcggaagcagcagtacatttgtcattcaaagacacaatcatccttaaataaagttaaataaaaccttattggcataanaaccgcgttggagatgcagctttatcggggactttgggaggaaggtgcttggaataagacatgagcattttaaaa

SEQ ID NO: 440 - DNA, 2545 bp, Homo sapiens
atccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcag

SEQ ID NO: 441 - DNA, 1172 bp, Homo sapiens
gagacattcctcaattgcttagacatattctgagcctacagcagaggaacctccagtctcagcaccatgaatcaaactgcgattctgatttgctgccttatctttctgactctaagtggcattcaaggagtacctctctctagaaccgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaatgtctaaaagatctccttaaaaccagaggggagcaaaatcgatgcagtgcttccaaggatggaccacacagaggctgcctctcccatcacttccctacatggagtatatgtcaagccataattgttcttagtttgcagttacactaaaaggtgaccaatgatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtactaaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattccaaacacatacaggaaggtagaaatatctgaaaatgtatgtgtaagtattcttatttaatgaaagactgtacaaagtataagtcttagatgtatatatttcctatattgttttcagtgtacatggaataacatgtaattaagtactatgtatcaatgagtaacaggaaaattttaaaaatacagatagatatatgctctgcatgttacataagataaatgtgctgaatggttttcaaataaaaatgaggtactctcctggaaatattaagaaagactatctaaatgttgaaagatcaaaaggttaataaagtaattataact

SEQ ID NO: 442 - DNA, 1859 bp, Homo sapiens
gcaggcacaaactcatccatccccagttgattggaagaaacaacgatgactcctgggaagacctcattggtgtcactgctactgctgctgagcctggaggccatagtgaaggcaggaatcacaatcccacgaaatccaggatgcccaaattctgaggacaagaacttcccccggactgtgatggtcaacctgaacatccataaccggaataccaataccaatcccaaaaggtcctcagattactacaaccgatccacctcaccttggaatctccaccgcaatgaggaccctgagagatatccctctgtgatctgggaggcaaagtgccgccacttgggctgcatcaacgctgatgggaacgtggactaccacatgaactctgtccccatccagcaagagatcctggtcctgcgcagggagcctccacactgccccaactccttccggctggagaagatactggtgtccgtgggctgcacctgtgtcaccccgattgtccaccatgtggcctaagagctctggggagcccacactccccaaagcagttagactatggagagccgacccagcccctcaggaaccctcatccttcaaagacagcctcatttcggactaaactcattagagttcttaaggcagtttgtccaattaaagcttcagaggtaacacttggccaagatatgagatctgaattacctttccctctttccaagaaggaaggtttgactgagtaccaatttgcttcttgtttacttttttaagggctttaagttatttatgtatttaatatgccctgagataactttggggtataagattccattttaatgaattacctactttattttgtttgtctttttaaagaagataagattctgggcttgggaattttattatttaaaaggtaaaacctgtatttatttgagctatttaaggatctatttatgtttaagtatttagaaaaaggtgaaaaagcactattatcagttctgcctaggtaaatgtaagatagaattaaatggcagtgcaaaatttctgagtctttacaacatacggatatagtatttcctcctctttgtttttaaaagttataacatggctgaaaagaaagattaaacctactttcatatgtattaatttaaattttgcaatttgttgaggttttacaagagatacagcaagtctaactctctgttccattaaacccttataataaaatccttctgtaataataaagtttcaaaagaaaatgtttatttgttctcattaaatgtattttagcaaactcagctcttccctattgggaagagttatgcaaattctcctataagcaaaacaaagcatgtctttgagtaacaatgacctggaaatacccaaaattccaagttctcgatttcacatgccttcaagactgaacaccgactaaggttttcatactattagccaatgctgtagacagaagcattttgataggaatagagcaaataagataatggccctgaggaatggcatgtcattattaaagatcatatggggaaaatgaaaccctccccaaaatacaagaagttctgggaggagacattgtcttcagactacaatgtccagtttctcccctagactcaggcttcctttggagattaaggcccctcagagatcaacagaccaacatttttctcttcctcaagcaacactcctagggcctggcttctgtctgatcaaggcaccacacaacccagaaaggagctgatggggcagaacgaactttaagtatgagaaaagttcagcccaagtaaaataaaaactcaatcacattcaattccagagtagtttcaagtttcacatcgtaaccattttcgccc

SEQ ID NO: 443 - DNA, 1496 bp, Homo sapiens
gactccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggagaatccattccaatatatggccatgtggctctttggagcaatgttccatcatgttccatgctgctgctgacgtcacatggagcacagaaatcaatgttagcagatagccagcccatacaagatcgtattgtattgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggcaaaaaaaaaaaaaaaaaaaaaaaaa

SEQ ID NO: 444 - DNA, 1629 bp, Homo sapiens
acacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaataaaaataaaaataaatttggttctaatagaactcagttttaactagaatttattcaattcctctgggaatgttacattgtttgtctgtcttcatagcagattttaattttgaataaataaatgtatcttattcacatc

SEQ ID NO: 445 - DNA, 1193 bp, Homo sapiens
tgaagatcagctattagaagagaaagatcagttaagtcctttggacctgatcagcttgatacaagaactactgatttcaacttctttggcttaattctctcggaaacgatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcaaggtcgaagagcatcccagtaatggttgtcctgcctgcaatatttgaattttaaatctaaatctatttattaatatttaacattatttatatggggaatatatttttagactcatcaatcaaataagtatttataatagcaacttttgtgtaatgaaaatgaatatctattaatatatgtattatttataattcctatatcctgtgactgtctcacttaatcctttgttttctgactaattaggcaaggctatgtgattacaaggctttatctcaggggccaactaggcagccaacctaagcaagatcccatgggttgtgtgtttatttcacttgatgatacaatgaacacttataagtgaagtgatactatccagttactgccggtttgaaaatatgcctgcaatctgagccagtgctttaatggcatgtcagacagaacttgaatgtgtcaggtgaccctgatgaaaacatagcatctcaggagatttcatgcctggtgcttccaaatattgttgacaactgtgactgtacccaaatggaaagtaactcatttgttaaaattatcaatatctaatatatatgaataaagtgtaagttcacaact

SEQ ID NO: 446 - DNA, 1182 bp, Homo sapiens; identical to SEQ ID NO: 375

SEQ ID NO: 447 - DNA, 1410 bp, Homo sapiens
gcgactgtctccgccgagcccccggggccaggtgtcccgggcgcgccacgatgcggccgcggctgtggctcctcctggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaattttacaaatgagcagagaatacggttttggtgtcctgctacaaaaagacatcggtcagtaacgagcacgatgtggaaaaatgagagaagggacacattcaaccctggagagttcaatggctgctgaagctgcctgcttttcactgctgcaaggcctttctgtgtgtgatgtgcatgggagcaacttgttcgtgggtcatcgggaatactagggagaaggtttcattgcccccagggcacttcacagagtgtgctggaggactgagtaagaaatgctgcccatgccaccgcttccggctcctgtgctttccctgaactgggacctttagtggtggccatttagccaccatctttgcaggttgctttgccctggtagggcagtaacattgggtcctgggtctttcatggggtgatgctgggctggctccctcttggtcttcccaggctggggctgaccttcctcgcagagaggccaggtgcaggttgggaatgaggcttgctgagaggggctgtccagttcccagaaggcatatcagtctctgagggcttcctttggggccgggaacttgcgggtttgaggataggagttcacttcatcttctcagctcccatttctactcttaagtttctcagctcccatttctactctcccatggcttaatgcttctttcattttctgtttgttttatacaaatgtcttagttgtacaaataaagtcccaggttaaagataaaaaaaa

SEQ ID NO: 448 - DNA, 3084 bp, Homo sapiens
ctgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacaatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaactttcccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagcttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagagactcctcagtgagaagaagacctgccagtgccctcaccggtttcagaagacatgtagccccatttgaggcacgaggccaggcagatcccacttgcagcctccccaggtgtctgccccgcgtttcctgcctgcggaccagatgaatgtagcagatcccaggcctctggcctcctgttcgcctcctctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatcccaggggagtgttcagggccagccctggctggcatggagggtgaggctgggtgtctggaagcatggagcatgggactgttcttttacaagacaggaccctgggaccacagagggcaggagcttgcacgaaatcacacagccaagccagtcaaggatggatgcagatccagaggtttctggcagccagtacctcctgccccatgctgcccgcttctcaccctatgtgggtggggccacagactcacatcctgaccttgcacaaacagcccctctggacacagccccatgtacacggcctcaagggatgtctcacatcctctgtctatttgagacttagaaaaatcctacaaggctggcagtgacagaactaagatgatcatctccagtttatagaccagaaccagagctcagagaggctagatgattgattaccaagtgccggactagcaagtgctggagtcgggactaacccaggtcccttgtcccaagttccactgctgcctcttgaatgcagggacaaatgccacacggctctcaccagtggctagtggtgggtactcaatgtgtacttttgggttcacagaagcacagcacccatgggaagggtccatctcagagaatttacgagcagggatgaaggcctccctgtctaaaatccctccttcatcccccgctggtggcagaatctgttaccagaggacaaagcctttggctcttctaatcagagtgcaagctgggagcacaggcactgcaggagagaatgcccagtgaccagtcactgaccctgtgcagaacctcctggaagcgagctttgctgggagagggggtagctagcctgagagggaaccctccaagggacctcaaaggtgattgtgccaggctctgcgcctgccccacaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaataaaaatacaataaacttactataaagataaaaaaaaaaaaaaaaaaaaaaaaaaaaaaaaaaaaaaaaaaaaaaaaaaaaaaaaaaaaaaaaaaaaaaaaaaaa

SEQ ID NO: 449 - DNA, 1670 bp, Homo sapiens
ccaaccacaagcaccaaagcagaggggcaggcagcacaccacccagcagccagagcaccagcccagccatggtccttgaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaatatcctcgctcccgggactcactggcagccccagcaccaccaggtctcccgggaagccaccctcccagctctgaggactgcaccattgctgctccttagctgccaagccccatcctgccgcccgaggtggctgcctggagccccactgcccttctcatttggaaactaaaacttcatcttccccaagtgcggggagtacaaggcatggcgtagagggtgctgccccatgaagccacagcccaggcctccagctcagcagtgactgtggccatggtccccaagacctctatatttgctcttttatttttatgtctaaaatcctgcttaaaacttttcaataaacaagatcgtcaggaccaaaaaaaaaaaaaaaaaaaaaaaaaaaaaaaaaaaaaaaaaaaaaaa

SEQ ID NO: 450 - DNA, 322 bp, Homo sapiens
aatataaggacttccattggtgtgcaggtggattcgtggtgctaaactatgttatgtgggtgtgggggccgaggagggggttgtgctctggcagcggtggcgccctaaatgatctataggtaaactctaatggcttccgcagggggtgcagtgcggaggacaagagcttggggctctctggctgagtgatctgggggacactcaagcggtttgtttctgtagaaatgggaatcttaaggcctctctggaaagggtgtgagggggtcgagggggagcgggcgccgggccttttgcgcttcattaggtgggtttgctttgcgag

SEQ ID NO: 451 - DNA, 568 bp, Homo sapiens
ttttttttttcagtctattccccctgtctggaaggcccttcatcctactctcttggcctcttctaatttttttcagtggagtccaaagtactcataaacacattcattaaaaatgtaagaagccaaagggcaaaaaaaaaattttttttaatcagggatgaggagggaagctaagaattttaaaatagtaaatgaaaaatttagaaatatgtattttgtagaaaatagtagacttagcactaagatgaaatgtttttggtaaagtttttaatttgggagttttgctgattccttcttacccttcaggacaattcacagatatcaatcctttctggagttacccctgactccctcaacaccccaaaactctaaatgccacggtcatctgtttctatatcaaccttttaacatatttatggccaggcgtggtggctcatgcctgtaatcctagcactttgggaggccaaggcaggagtcactgcgcctggccaattttcatatttttagtagagacggggttttaccatgttggccacgctggtctcgaactcttgatctcaagtgatct

SEQ ID NO: 452 - DNA, 1103 bp, Homo sapiens
cacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatag

SEQ ID NO: 453 - DNA, 4156 bp, Homo sapiens
gttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggtgagagaactggaccctcggaaaccctccgagtcccgaattcgttggttcctctagggctctacttctcgcctgccctgttttcttcgctgcactggctccttcctgtacttgcctaattttgcctcacctccttccactccatcccgcctgcaggcttcggcaccctagttcttcccagggccgtccacccatcttctctgccttacctgtgcccgcacccccgccccgcacatctggcgggagcttctggtaacatcttgagccgctcaagagtgagcgagggctcctcttttgagcccgacaaagctgcgtccctttaaagccatcacttcctttctcttgtctgctcaagtgcaagttctagattgtttccagaggttttagtagtttattgttggagtagaggcgtgaagtcttgcaaaggttttttgccctgacatctcttcgtcttgtgtttttacttgcatttggcttgatgatcattgtgtgtattgatcaatggaagaacaaaatctggcctgaaataaaagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgagcttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttttaaagcaaacttgtcctttggttttgcagaacaggcctgctccctctcatctagcccaccatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtgatgtgagacagaaacctaaacatggtacttgattctaaacctgtgccagtctatagcctctgcctccccaagcagagctcaagccaaacgcttctgtcctctttccttctgcattaaccctttgctgatcctcaggggccactcccccaacacccctgtacttgggtgagggatgttggacagagcctgttttcatgtactgcaggtgggggtgtgctgacatgtttgctcttggttgatggagaaggtacagaggccagggagtgaaaatggttgacagaagagggaagagttaggtgtctcatagtcactcatagtggggtggtcaggggtaatggcatctccccactttaggcttctcaaacagacttttgacacctctcaagttcagagctctgatgtggaaagacaggaggtgtggggaaggagggggatttcgtgtgtttgcatgagtgtgcgcttcaggccttgggagttggcaagagggagggaaggaaggagagcaaaatcttcggaaggtgtttcttgtacctgagggatcctgccctgaatctccatagtctccactgtgaactgaggaggggaggggtgtgctggggaataaatcttgtatgagaacaatc

SEQ ID NO: 454 - DNA, 2075 bp, Homo sapiens
gccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggt

SEQ ID NO: 455 - DNA, 1285 bp, Homo sapiens
gggctgcctgtgacgcgcggcgcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttctgtttaagcaccatggccttgatgattcactgttggggagaagaaacaagaaaagtaactggttgtcacctatgagacccttacgtgattgttagttaagtttttattcaaagcagctgtaatttagttaataaaataattatgatc

SEQ ID NO: 456 - DNA, 1188 bp, Homo sapiens
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtcactgacagtgcccagggctctggggtgtctctcacagctaataaagtgtgagacagcttccttgtgtgggactgagaagcaagatatcaatgtagcagaattgcacttgtgcctcacgaacatacataaattttaaaaataaagaataaa

SEQ ID NO: 457 - DNA, 1727 bp, Homo sapiens
ctacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccattttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttcagaaggcttcttgcttgttgacaagtaccgcaaaggctttattctggactggctatctcataaaaggatttctgtaagactttgcagtgtcattccctcagaacctaggtttgtttctaaagccacggtattgtccaggagcccctgtgtgtggggcaggtagctatccctcccatgtcattagtaatcctttaggatttaaggtacaactggacagcatcattccttccccttattgtgccaaatccccaccatcagccttgccattgccttaagatttgattattgcacccaattacctaaccactaaacagaaaggccaccttcactctttgaaaaaggcaagctgtgcttagaaacactgcttttaagagtagcacatttgagtgtgactttttccccccttcactatttcaaaatggttttgaaatggggtcttaaaggtaagcgccctcatacatgactgaaactttgtgagaggtcttatatttgaatggacccttaatgatttatgtgaaatagaatgaagtcctgtctctgtgagagaacgtgcctcctcactcatttgtctctgtctgttttcatagccatcaatatagtaacatatttactatattcttgaatacccttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctccacgtctgaggtcacctgccctgtgtggggcacaccaccgtcagcaccaccgtttttacagttactttggagctgctagactggttttctgtgttggtaaattgcctatataaatctgaataaaaaggatctgtac

SEQ ID NO: 458 - DNA, 1046 bp, Homo sapiens
ataaacaacttgatgcagatgtttcccccaagcccactatttttcttccttcgattgctgaaacaaaactccagaaggctggaacatatctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaagacagttattcaaaagatgcaaatgatgtcaccacagtggatcccaaatacaattattcaaaggatgcaaatgatgtcatcacaatggatcccaaagacaattggtcaaaagatgcaaatgatacactactgctgcagctcacaaacacctctgcatattacatgtacctcctcctgctcctcaagagtgtggtctattttgccatcatcacctgctgtctgcttggaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataatggttttcaaaccagtgggcacacagagaacctcagtctgtaataacaatgaggaatagccatggcgatctccagcaccaatctctccatgttttccacagctcctccagccaacccaaatagcgcctgctatagtgtagacagcctgcggcttctagccttgtccctctcttagtgttctttaatcagataactgcctggaagcctttcattttacacgccctgaagcagtcttctttgctagttgaattatgtggtgtgtttttccgtaataagcaaaataaattt

SEQ ID NO: 459 - DNA, 169 bp, Homo sapiens
cgtgtttgcagcctctagaaaagaagtgtaattataaaaaacatttaccataaccgtaacaatgaatgaagaaaggaagacttggttcttctagctctggacaaaattccattttttttaaaaaaaatattgatttccagctgaagtatagtacatctctgatgttttc

SEQ ID NO: 460 - DNA, 4465 bp, Homo sapiens
caattgtcatacgacttgcagtgagcgtcaggagcacgtccaggaactcctcagcagcgcctccttcagctccacagccagacgccctcagacagcaaagcctacccccgcgccgcgccctgcccgccgctcggatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtcttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactatcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagatgaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatctcaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataacgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactattta

SEQ ID NO: 461 - DNA, 3056 bp, Homo sapiens
agcgggatttgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggtaggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatcaacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagagttcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggagacccacttggtggtgctggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcatccatgggggccacagcccctgaagcccagagggagactgtgtttgtgtgtgcctcgtgtaaccagaccttgagcaagtgagaagagaggccagggtccaaccaggcacccgtccttggggccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgccctgctctgcctgggactgagcgagtggacttagggctgggcaggcagtagccaccagagggcagcagcgaactaggccaggcctgactggggtctgaagatcagggtcagtgtggctatgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcagcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcaaaagaaaaaaaaaaaaaaaa

SEQ ID NO: 462 - DNA, 2615 bp, Homo sapiens
gaattccgggaagccagacggttaacacagacaaagtgctgccgtgacactcggccctccagtgttgcggagaggcaagagcagcgaccgcgcacctgtccgcccggagctgggacgcgcgcccgggcggccggacgaagcgaggagggaccgccgaggctgcccccaagtgtaactccagcactgtgaggtttcagggattggcagaggggaccaaggggacatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattt

SEQ ID NO: 463 - DNA, 1432 bp, Homo sapiens
gctgttcggcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcctgcgtctg

SEQ ID NO: 464 - DNA, 2073 bp, Homo sapiens
ggggcgtcccgggatatttggaggataaagggtgatgaccacacctgccggctccggcagcggcttcggctccgtgtcctggtggggcctgtccccggcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagcagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccaccaaaaaaaaaaaaaaaa

SEQ ID NO: 465 - DNA, 1124 bp, Homo sapiens
cgggaaacctgcactgacttttttctccttttggagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagaagcaggcccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactgaaaaaaaaaaaa

SEQ ID NO: 466 - DNA, 1066 bp, Homo sapiens
accccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcatctgaggacttaaagaagcatggtgccactgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtgcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctc

SEQ ID NO: 467 - DNA, 3144 bp, Homo sapiens
atggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgcgttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcagagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaaggagtcagttatttttattcatatattttagcatattcgaactaatttctaagaaatttagttataactctatgtagttatagaaagtgaatatgcagttattctatgagtcgcacaattcttgagtctctgatacctacctattggggttaggagaaaagactagacaattactatgtggtcattctctacaacatatgttagcacggcaaagaaccttcaaattgaagactgagatttttctgtatatatgggttttgtaaagatggttttacacactacagatgtctatactgtgaaaagtgttttcaattctgaaaaaaagcatacatcatgattatggcaaagaggagagaaagaaatttattttacattgacattgcattgcttccccttagataccaatttagataacaaacactcatgctttaatggattatacccagagcactttgaacaaaggtcagtggggattgttgaatacattaaagaagagtttctaggggctactgtttatgagacacatccaggagttatgtttaagtaaaaatccttgagaatttattatgtcagatgttttttcattcattatcaggaagttttagttatctgtcatttttttttttcacatcagtttgatcaggaaagtgtataacacatcttagagcaagagttagtttggtattaaatcctcattagaacaaccacctgtttcactaataacttacccctgatgagtctatctaaacatatgcattttaagccttcaaattacattatcaacatgagagaaataaccaacaaagaagatgttcaaaataatagtcccatatctgtaatcatatctacatgcaatgttagtaattctgaagttttttaaatttatggctatttttacacgatgatgaattttgacagtttgtgcattttctttatacattttatattcttctgttaaaatatctcttcagatgaaactgtccagattaattaggaaaaggcatatattaacataaaaattgcaaaagaaatgtcgctgtaaataagatttacaactgatgtttctagaaaatttccacttctatatctaggctttgtcagtaatttccacaccttaattatcattcaacttgcaaaagagacaactgataagaagaaaattgaaatgagaatctgtggataagtgtttgtgttcagaagatgttgttttgccagtattagaaaatactgtgagccgggcatggtggcttacatctgtaatcccagcactttgggaggctgagggggtggatcacctgaggtcgggagttctagaccagcctgaccaacatggagaaaccccatctctactaaaaatacaaaattagctgggcatggtggcacatgctggtaatctcagctattgaggaggctgaggcaggagaattgcttgaacccgggaggcggaggttgcagtgagccaagattgcaccactgtactccagcctgggtgacaaagtcagactccatctccaaaaaaaaaaaaaaaa

SEQ ID NO: 468 - DNA, 1177 bp, Homo sapiens
gccaaggctggggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaaaaaaaaaaaaaaa

SEQ ID NO: 469 - DNA, 1323 bp, Homo sapiens
gtggaggttgctgctatgagagagaaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcgttacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgcaaaaaaaaaaaaaaaaaa

SEQ ID NO: 470 - DNA, 2781 bp, Homo sapiens
ggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtattatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgtttttttttaaatagacctctcaatttctggaaaactgccttttatctgcccagaattctaagctggtgccccactgaatcttgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattcaaaaaaaaaaaaaaaaaaaaaaaaaaaaaaaaaaaaaaaaaaaaaaaaaaaaaaaaaaaaaaaaaaaaaaaaaaaaa

SEQ ID NO: 471 - DNA, 1363 bp, Homo sapiens; identical to SEQ ID NO: 340

SEQ ID NO: 472 - DNA, 1080 bp, Homo sapiens
caggcgcatcagggcctgctctagggctataagttccccatagatttttctatacatggaataggcctccttggagatggcgttatttcccaggtggcggcagatgaacttgatcatggaaaagctgttcacaaaggcaagcctccctgaccgttcccagtaggtgttgatgcacagggacaccaaaggcacgttcatgacaaacttttcctcaaacccgtggatcatagcctcgactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacagccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtgtacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtga

SEQ ID NO: 473 - DNA, 195 bp, Homo sapiens
ccctgaaggtgaaccgcttaccacctcctcttcttgctggacgaggacccttctacggactcgtctgggttcttggccccctctggtaggactgggcgaccggtgccttcttaggagctgtccgaggggaccctctggcccgataccggggggcccgggccgggttggtccagggccttcacttcggtctcccct

SEQ ID NO: 474 - DNA, 223 bp, Homo sapiens
aacggaaagtccgaatcctacacatttctagtcgtgacggctagctttttggtggtcatggcggtggtggtcaacatatatctccagatacaggagatgaggaaaaaaaaggaggacaagtctaacggaataatatccgatcatatatatggagggatatcaggtcatcattgtgtatcaaaagatgatttgtacaacagggaaggatacggttttaaaggtt

SEQ ID NO: 475 - DNA, 249 bp, Homo sapiens
tcataaggtaacgatgctactttttttaattccaagatggtttttctttgttagtcttttgttgacttgctggttcctaaaagttcgcaaaaacgattgtgtgaagattttatgacgttggttgactagttcatgagattctgctgtacgtgtgatggttattcgctggttcgttctaagatgagtatcgtactgtgtctgcgatggtcgtctcttactggcattctctcggctgcctcttgctttcat

SEQ ID NO: 476 - DNA, 185 bp, Homo sapiens
  misc_feature (54)..(54): n is a, c, g, t or u
  misc_feature (62)..(62): n is a, c, g, t or u
  misc_feature (110)..(110): n is a, c, g, t or u
  misc_feature (137)..(137): n is a, c, g, t or u
cgagttctgccaggacatctttctcggggttctcgttgcaatcctcggtcactngttcaaangttttgagggattcttcggccaactctggaaacagcgggtctcccagnctcagctgactgttaacctccttcctnaacatagtctgcaggaacgtcgtggccttggtcacgggtgtctcgggc

SEQ ID NO: 477 - DNA, 300 bp, Homo sapiens
  misc_feature (11)..(11): n is a, c, g, t or u
  misc_feature (17)..(17): n is a, c, g, t or u
  misc_feature (32)..(32): n is a, c, g, t or u
  misc_feature (34)..(35): n is a, c, g, t or u
  misc_feature (50)..(50): n is a, c, g, t or u
  misc_feature (103)..(103): n is a, c, g, t or u
  misc_feature (110)..(110): n is a, c, g, t or u
  misc_feature (116)..(116): n is a, c, g, t or u
  misc_feature (122)..(122): n is a, c, g, t or u
  misc_feature (134)..(135): n is a, c, g, t or u
  misc_feature (149)..(149): n is a, c, g, t or u
  misc_feature (152)..(152): n is a, c, g, t or u
  misc_feature (159)..(159): n is a, c, g, t or u
  misc_feature (169)..(169): n is a, c, g, t or u
  misc_feature (172)..(172): n is a, c, g, t or u
  misc_feature (182)..(182): n is a, c, g, t or u
  misc_feature (197)..(197): n is a, c, g, t or u
  misc_feature (204)..(204): n is a, c, g, t or u
  misc_feature (257)..(257): n is a, c, g, t or u
tctcatcaggngagcantgaggcaagttctgnanngccgccatggcctgnctgcagccattggtggtcttagggaaggctgagttcttggtaaagaactctanattcctntagcanatatanatcatctttctnntaagttcatccttnttngcacggnccttagcctncantgcacccccnaacttgttagcggcncccttgntcacatcatgcagctccttaatacaagccatccacatctcccgcttatcctcnggtacaatgtagttctcatacatgctctgcatagttagcccaa

SEQ ID NO: 478 - DNA, 363 bp, Homo sapiens
cttgacagcccggcaggcagcatccctgatattccttgcggtatatggtgtgatgtcgtgtggaggcaaccatggcggcacattgtcttccgtgtctaaaagatggccggacaaggcagcccgtcttctccgccttcgcctgatgcgctgcatccagcctctgttttcatcacccctgctttgcccccaaggttgctgatctcttgagtatgactcttctggtaccaatctctcagaagccccactggatggaggccccggcccagggtcctgatcatgctcgccggtagtctgtacattatctccccgctcattgtcgggtgactgtctagagtccccctgtccttcaaatgattccatggt

SEQ ID NO: 479 - DNA, 600 bp, Homo sapiens
gagttagaaatttaagagatcctcgtgtaaaacatctggtgtccgggggataatggagtcaacatccaggcttgggcacatctgcttcaacaggaggcgcagcctgtcattttcagatgatttggcagcagccacctcacggtagtgctgcagcagttgcttaaacttggcccggcattttctggaagccacccgattcttgtatcgctttatttctagttcagaatcgcattcctccagcgattctggctgttgtggtttccgtgtgcgtcgtgccggggcagccactggtgcaggctgtggaacaccaatgtctgctagctgttgtccttggttagccccggggcaagcaaacaccactgctgctgctgtttgaacagtagaattgtctccaggttgaggtgcttctcccccggcttggttagtctgttgattctgggttatgtcggagactgggaacagctgaggtgctgcataagcttgataagcattctcaggagcaggctgaggggcagaaaaccacgacccagtcggagcggttgaaacatgataggcagttagctggccttgtggcagaggctctggcagcaccggccacag

SEQ ID NO: 480 - DNA, 146 bp, Homo sapiens
ccctgaaggtgaaccgcttaccacctcctcttcttgctggacgaggacccttctacggactcgtctgggttcttggccccctctggtaggactgggcgaccggtgccttcttaggagctgtccgaggggaccctctggcccgatac

SEQ ID NO: 481 - DNA, 66 bp, Homo sapiens
cctaggggagaccgaagtgaaggccctggaccaacccggcccgggccccccggtatcgggccagag

SEQ ID NO: 482 - DNA, 176 bp, Homo sapiens
cctctacagtcaaacagattaaggttcgagtggacatgctgcggcatagaatcaaggagcacatgctgaaaaaatatacccagacggaagagaaattcactggcgcctttaatatgatgggaggatgtttgcagaatgccttagatatcttagataaggttcatgagcctttcgag

SEQ ID NO: 483 - DNA, 185 bp, Homo sapiens; identical to SEQ ID NO: 476
  misc_feature (54)..(54): n is a, c, g, t or u
  misc_feature (62)..(62): n is a, c, g, t or u
  misc_feature (110)..(110): n is a, c, g, t or u
  misc_feature (137)..(137): n is a, c, g, t or u

SEQ ID NO: 484 - DNA, 641 bp, Homo sapiens
atttaaattctgcagctcagagattcacacagaagtctggacacaattcagaagagccacccagaaggagacaacaatgtccctgctacccgtgccatacacagaggctgcctctttgtctactggttctactgtgacaatcaaagggcgaccacttgcctgtttcttgaatgaaccatatctgcaggtggatttccacactgagatgaaggaggaatcagacattgtcttccatttccaagtgtgctttggtcgtcgtgtggtcatgaacagccgtgagtatggggcctggaagcagcaggtggaatccaagaatatgccctttcaggatggccaagaatttgaactgagcatctcagtgctgccagataagtaccaggtaatggtcaatggccaatcctcttacacctttgaccatagaatcaagcctgaggctgtgaagatggtgcaagtgtggagagatatctccctgaccaaatttaatgtcagctatttaaagagataaccagacttcatgttgccaaggaatccctgtctctacgtgaacttgggattccaaagccagctaacagcatgatcttttctcacttcaatccttactcctgctcattaaaacttaatcaaacttcaaaaaaaaaaaa

SEQ ID NO: 485 - DNA, 2165 bp, Homo sapiens
tgcgccgcggctgctgctgcgcaggcccagtgctgcgcttcgcggcagaggcgtctgcggtgacagctcagtcagttgagctctgtgtgccaggcgctcgggagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagcacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcacaggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggagtaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtaagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtgatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcgaaaaaaa

SEQ ID NO: 486 - DNA, 1098 bp, Homo sapiens
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtccctcacagcttgtaaagtgtga

SEQ ID NO: 487 - DNA, 242 bp, Homo sapiens
tttttttttttttttctgattctatgcttgtgcatgaccctgatgagtagtaaatcaattcaacaagaaggttgaattgttacccagtaactttcattcttcttagggtatgaaaattggccactgaatgttctgttccaaaattccctaagcaagttaagctaaatatctggattaaaagatttattttgattttaaaatggacactacatatctggcttatttagtctgccctcgtgccg

SEQ ID NO: 488 - DNA, 3415 bp, Homo sapiens
ccccctcccctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccagcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgctttttttctgttcccctccgctttctgaagcctggggagaaatcagtgacagaggcgctctctgggttttattgttatgtgggttttcttttgtattttttttgtttgttttgtttttaaacattcaaaagcaattaatgatcagacataggagaaaccctgaatagaaacaaaacttttgaatgctggattcaaaaaagaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttggttgttttgagggagagaggcggggtgggggggtgcaaatctgccagcagctcttacgtaaggcatgttttattggggagggctgagcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagagctatgccctgacctacccctgattctatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtgatgggggagtgggtattacatgcattgctgaagagtcatcctggtgttcctcattcctcccaccttcccgtggtcattttaattacggggcagtgtcaccgcaaagggaggaaactcaaagccgaaagcaaaattccaggcctgattctggcttttgaggttcctggttcttgaagccaggcctgacccgactctcagatggggtcagtcccgtcgctttgcagactgaccctggaaatctacaaaatgcagattttcctgatttcctcttctcttgcccagtttttttttttttttttttttttttttttaaagcctggattgtaaccagattttcttttttcccccttctcagctgtagatatgatatctcctttcagggccccagcttaagggcaaagtgagttaatgtgtagacaaaggcgagggacaagagagagttaacatctagacagtggaaaaagccatggtgtgtggtttctgggaaccaccaacacttgcaggtttagctttttcccagggttgactacaagaaagaaaaccatgtttttgcaagattaaaatgtggttgagtgtgcctaaattaaccatccccatttttatcatatttccaccatcacttcagggttttaagagtcagtgctcacctgggcggagctggtagtacattttgcttcttagaaagctaagtcctgggttccgtctgattttaggttccaggaacttcctgagaacacccgatcgcagagggtaattttctggagtttgttttgcagggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaa

SEQ ID NO: 489 - DNA, 2473 bp, Homo sapiens
aatcgcgaaacccggcgagcggcgcgctggctatcgagcgagcggggcggaaccgggagttgcgccgccgctcgggcgccgggctccgtcgcggccgcagccccgcgggtcgccctcccgtgcctcgcccgcggacaccctggccgtggacaccctggccgtgggcacccgcggggcgcggcgcgggcgctgcgcggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagggtggcccagttgaaatccttcccttcctctaccttggaagtgcctaccatgcatccaagtgcgagttcctcgccaacttgcacatcacagccctgctgaatgtctcccgacggacctccgaggcctgcatgacccacctacactacaaatggatccctgtggaagacagccacacggctgacattagctcccactttcaagaagcaatagacttcattgactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataagccaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtcaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaactgtggacttctgggatttgcagattttgcaacgtggtactacttttttttctttttgtctgttagttatttctccaggggaaaaggcaataattttctaagacccgtgtgaatgtgaagaaaagcagtatgttactggttgttgttgttgttcttgttttttatatgtaaaataaaaatagtgaaaggag

SEQ ID NO: 490 - DNA, 1216 bp, Homo sapiens
ggtgttcactcaacttggatctgtgctgaaaaattgtgacatttcagtacatctggtagagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagc

SEQ ID NO: 491 - DNA, 5590 bp, Homo sapiens
ttttaccacgatgtaaacaaacaaacaaaaaactctcggcattgcccccactccctggcagtgtctattgtgggaggagagaccgaaattctcaggacacacccaggcctcaagacttctcgcccaatccgtcaccacttcctggcgcagacatcggactgttaaggcccctccacttcccgctcaggttacagaccccagggcacatccccccatcctcacccgcctgcatgaccaggctgccccctgccccgcacacctctctctgagtagcctcctgtcttccctctggcagctgagtcagcttcaccacctcactgggtctggaacagccaactcctgacactttcacactcacagaggtggagcaggggcacgggggctgggcaccaccagtgtgtgggcagcacccaggcattaaacacagcagaggatggcgcaggcacccctgttctcctcccagagccaagcttcaggccatgtccagcgggggaggctgtgagtcacctctgcctcatgtgggtgatcataggagggtgtgagtcagctctgtccacatggttgctcatgggagggtatgagtcagctctgtcaatgtgggtggtgggtggtcacgggagggtgtgagtcagctctgtccacgtggttgctcataggaggttgtgagtcagctctgtccatgtggggtgctcacaggagggtgtgtgtcagctctgtctgtgtgggtggtcacgggagggtgtgagtcagctctgtctgtgggtggtcacaggagggtgtgagtcagctctgtctgagtgggtggtcacgggagggtgtgtgtcagctctgtctgtgtgggtggtcacgggagggtgtgtgtcagctctgtccgtgtgggtgctcacgggagggtgtgagtcagctctgtctgtgtgggtggtcacaggagggtgtgtgtcagctctgtctgtgtgggtgctcacgggagggtgtgagtcagctctgtctgtgtgggtggtcacagaagggtgtgtgtcagctctgtgtgggtgctcacgggagggtgtgagtcagctctgtctgtgtgggtggtcacaggagggtgtgtgtcagctctgtctgtgtgggtggtcacgggagggtgtgagtcagctctgtctgtgtgggtggtcacaggagggtgtgagtcagctctgtctgtgtgggtggtcacaggagggtgtgagtcagctctgtccatgtgggtgctcacgggaggttgtgagtcagctctgtctgtgtgggtggtcacaggagggtgtgagtcacctctgcctgtgggtggtcacgggagggtgtgagtcagctctgtctgtgtgggtggtcacaggagggtgtgagtcagctctgggtggtcacgggagggtgtgagtcagctctgtctgtgtgggtggtcacgggagggtgtgagtcagctctgtctgtgtgggtgctcacgggagggtgtgagtcagctctgtctgtgtgggtgctcacaggagggtgtgagtcagctctgtctgtgtgggtggtcacgggagggtgtgagtcagctttgtctgtgtgggtgctcacaggagggtgtgagtcagttctgtgtgggtggtcacaggagggtgtgagtcagctctgtgtgggtggtcacgggagggtgtgagtcagctctgtctgtgtgggtgctcacaggagggtgtgagtcagctctgtctgtgtgggtggtcacgggagggtgtgtgtcagctttgtctgtgtgggtgctcacaggagggtgtgagtcagctctgtccgtgtgggtgctcacaggagggtgtgagtcagctctgtgtgggttgtcacgggagggtgtgagtcagctctgtctgtgtgggtggtcacaggagggtgtgagtcagctctgtctctgtgggtggtcacaggcgggtgtgagtcagctctgtctctggggtggtcacaggcgggtgtgagtcagctctgtctctgtgggtggtcaccggcgggtgtgagtcagctctgtccgtgtgggtgctcacaggagggtgtgtgtcagctctgtctctgtgggtggtcacagtagcgtgtgagtcagctctgtctgtgtgggtggtcacgggagcgtgtgagtcagctctgtctgtgtgggtgctcacaggagggtgtgagtcagctctgtgtgtgtgggtggtcacaggagagtgtgagtcagctctgtgtgtgtgggtggtcacaggagggtgtgagtcagctctgtctctgtgggtggtcacgggagggtgtgagtcagctgtacgtcatgtagttggtcatctgtgtgttccacctgcatcctggggtagcctgttggccatttttgttgccactataaagccctgagtgtggctaggaagggggtgctgggtgggaccgtatgatcacgtgtgctcagtttggcatgtgtgatcgtcatgtgactgggctcacagaaaggagcttgtccctaatgatttccaaccttcggactgtgtcctgacctggcctgtagtcctgctgtctgggtttgcatggccccgagagcccttctgaacaaaggatgctgatggattcaagccagcttggtgggtgccgggccctccctcccacctcctttagtctttatgttgaccttgagctggggtggtcctgggaccccgaggttcgtgagcggaagggcttgcaggagggcacacagcaggggagctgggagagggggcttgtttgcctcagcattgggggagccgaggaaacgttcatgaaagcttctgaaagggaagcaggaaggattttcaccccagggctgcagcttcagggactacatgagggtatgggtggggatgaggggaaggcccacagggtgttattcccatctcatcgtcctcctctggctttgctttgtgttgcgaacccgcatcctgaggctgacttcagaatgttaagaaaggcagccctgagcctttgatcaccccaggagttccagaaggcaccagggagtcctctcgggtcccatgcccctcccagccccttggggtcaccctgatcggcctggccaaggtcgccagctgcctggggactggggagcagccacatgccctctgcaggggagtagttgccaggaaggtgcaggcggaggccctgctctccatcacagcggtcctgattatgagatcgtcactctcaagaggccaaaagttatgaccaaacttcaagagaaactcccagtaaagtagtatttccacagcagacagttgggatgcaggtccacccacagccagctctgagctgacacaggggccctggccagggttccaccctgctctgcctgcctggggccctggctagcctgcagataacatcaagtagtttcgtaatttccacacacagca[450 bp omitted]ctctcaggccaagaggagccctggggtgagcaacagccctgtggccttgctttcgggttcaggtggtgcagggagccaccccggacctccgtgaaggccagtgaaatggacaggacaaggtgcttggcctgcggctggagagcccatcttcttaccccctggccacatggttctgggaaggcactgacgctttgtaaaacttgcctggtgtggaaaatgatggcggtcatatgtagtaccttagaaggctgtgctgggagttaacgatataacatagcgcaaatgcctgacccctgggagaggggcagtgagagtttgttgaagttggcatgtgaagtcgaggctctcagtgaggtgcagacttttcctgtccaggaatgggagacaaggagctgtcattcactcaagcccttcgtctgccagcccctggcctgttatacaccccttttcaatcctgtaaggtaagtgttcttatctccaacttccaggtgggaagtctgaagctcagagagcctgggccaatggtacaggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttgccacgaaatatgcagcttcctttccctgagaaaatggcaaagaaaattcaacacagaaggccagggagggtgtgtggaaacgattcacatgttcaaaagatttatatgtgtagaagaaagctgtgaagtgtgaagtatattttctattgtagaatggatgaaaatggaataaaaataatatcctttgctaggcagaataaataacttctttaaacaattttacggcatgaagaaatctggaccagtttattaaatgggatttctgccacaaaccttggaagaatcacatcatcttagcccaaggtgaaaactgtgttgcgtaacaaagaacatgactgcgctccacacatacatcattgcccggcgaggcgggacacaagtcaacgacggaacacttgagacaggcctacaactgtgcacggttcagaagcaggtttaagccatacttgctgcagtgagactacatttctgtctaaagaagatgtgagtcctaagcagacttaaagccaagaaaataagaagaggaaagagagagggcctgccttaaccacctgtggtgctgacttggacaattccaggtcaagaggaactgtctactttcgactttgtgtgatagtaactttttaagcagtggaccgggagcccaagactcagatgcagcaagctttgcaaggctgacgagagctgagatcttcagtggccgatgggtacagggctgctgggagcgtagccacgtctgctccaaggtggcttgaatgaggcagtgcccaagtccttttgactggctgaggtgagcctgtggctcagtcacactttgtccctctcgtaataagtgcatttcccagacagcagctccttggtgtcatgcaactgaggaacctaattgtctgggtgggttgttcccatccaacttccacctgtcacgaaggttgctttttcagatcagtctccacagctaccatcttgtcgggcacagagccgggcatcaacaagtgtatgttgaataaagaatgaattgatg

SEQ ID NO: 492 - DNA, 2057 bp, Homo sapiens
ccgtgcagcccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccaaacctctggggtatccagcagtggccaaagcgtcagctccaaccagcgtccctgtagttcggacatccccgactctccctgcagtggagggcccatcgtctcgcactctggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctatcctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcgttccagccagtggggactggtggggtccagctctgtggaggcggctccacgggctccaagggaccctgctctccctccagttctcgagtccccagcagttctagcatttccagcagctccggttcaccctaccatccctgcggcagtgcttcccagagcccctgctccccaccaggcaccggctccttcagcagcagctccagttcccaatcgagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagtcaactgttgtgtgtgtgcatgccttgggcacaaacaagcacatacactatatcccatatgggagaaggccagtgcccaggcatagggttagctcagtttccctccttcccaaaagagtggttctgctttctctactaccctaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcaccttctcaactgggaaacccctgaaatgctctcagagcacctctgacgcctgaagaagttataccttcctcttcccctttaccaaataaagcaaagtcaaaccatcaaaaaaaaaaaaaaa

SEQ ID NO: 493 - DNA, 629 bp, Homo sapiens
  misc_feature (605)..(605): n is a, c, g, t or u
acaaataggacaaagaaagtaagaagataaatgatgacttttatttgccaacatttggttcagcacaactttcctaccctgtctctccccacctttgcccttaggctaaggagcagaaaagtgatttgtcaagatggagcaaggtatttaccagtctaaaacctaatgctgtaaaactaaatgagacaacttggggcttgaatgggtgctgggctgtaggtactgctgggtcactgttgctataaatggtcactggagcagattaataaatcaaggatcagtttcacccacatttaaaggactacttgactcatttctgtctcgagtaaatggactttggtagtagcaacgccataccgtgatgatatcatttgtgttgggaatcaaactgggcaatgcaagagtgtttttgaagcctaaatctatgtaagacttatcagtttgggagaggataataataaaagtaacaatcaatgcttccaaactccaattgactgtcttttttagcttttatatttacctagttgttatgctaaccaattcagctttttactgttgctgttgttgttgttttaagaaataaaatttctgattgctgttttcanaaaaaaaaaaaaaaaaaaggacgc

SEQ ID NO: 494 - DNA, 514 bp, Homo sapiens
cttcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatcaaaaaaaaaaaaaaaaaaaaaaaaa

SEQ ID NO: 495 - DNA, 1283 bp, Homo sapiens
ctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacc

SEQ ID NO: 496 - DNA, 512 bp, Homo sapiens
cctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttt

SEQ ID NO: 497 - DNA, 414 bp, Homo sapiens
ttttttttttttttttttttttttttttttttttttttttttttttttttcccaagggctttttttttcaaagggccccccaaaaattccttttttaaaattccgggccttggggtttttagtgggaaatccaaaaaaaaaagccaaggaaacccctgcttgaaaatatttttttttccggggcaaccaaccaaaattgccccttttttttttcccgaaatgaccaggggggacccccccctttttcccctcacatcctttgatttgcacagggctaagggttccaaaaacatggaaaattttgaactttgtttttttttgggttcaaaatcctgccccccaccctcgtaggaggcaaattctggaaaaatggattatttgtggttggaaaaaacaaaaaaaaaaatggggccg

SEQ ID NO: 498 - DNA, 6087 bp, Homo sapiens
gccccgcggctccgaactcggtggtcctggaagctccgcaggatgggggagaagatggcggaagaggagaggttccccaatacaactcatgagggtttcaatgtcaccctccacaccaccctggttgtcacgacgaaactggtgctcccgacccctggcaagcccatcctccccgtgcagacaggggagcaggcccagcaagaggagcagtccagcggcatgaccattttcttcagcctccttgtcctagctatctgcatcatattggtgcatttactgatccgatacagattacatttcttgccagagagtgttgctgttgtttctttaggtattctcatgggagcagttataaaaattatagagtttaaaaaactggcgaattggaaggaagaagaaatgtttcgtccaaacatgtttttcctcctcctgcttccccctattatctttgagtctggatattcattacacaagggtaacttctttcaaaatattggttccatcaccctgtttgctgtttttgggacggcaatctccgcttttgtagtaggtggaggaatttattttctgggtcaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaacacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcaggcatcatggccatcctgttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccccgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctg

SEQ ID NO: 499 - DNA, 657 bp, Homo sapiens
cccggcacaccccgtaggaccaatgctcaggccaaaggtgtccaaactatacagacccacagaatctaacaacagatgtctcaatattcctcgtcctagaactctcagaggatccagaactacagccggtcctcgctgggctgttcctgtccatgtgcctggtcatggtgctggggaacctgctcatcatcctggccgtcagccctgactcccacctccacacccccatgtacttcttcctctccaacctgtccttgcctgacatggtttcacctccaccatggtccccaagatgattgtggacatccaatctcacagcagtcatctcctatgcgggctgcctgactcagatgtctctttttgccatttttggaggcatggaagaaagacatgctcctgagtgtgatggccctatgaccggtttgtagccatctgtcaccctctatattattcagccatcatgaacccatgtttctgtggctttctagttctgttgtcttgtcgtctcagtcttttagactcccagctgcacaatttgattgccttgcaaattacctgcttcaaggatgtggaaattcctaatttcttctgtgaaccttctcaaatcccccagcatgcgtgtagtgacaccttcaccaattaacatagtcatgtatt

SEQ ID NO: 500 - DNA, 1909 bp, Homo sapiens
gctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttgggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaaa

SEQ ID NO: 501 - DNA, 912 bp, Homo sapiens
cgcttccgcctacctcgcccaggctgccagaccggaagcgctccgctgtacctggatcctgctcctctgggttgaaacccgggcgccgccaagatgccggcttaccactcttctctcatggatcctgataccaaactcatcggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacatttctgaatgtctgaagaaactgcaaaagtgcaattccaaaagccaaggtgagaaagaaatgtatacgctgggaatcactaattttcccattcctggagagcctggttttccacttaacgcaatttatgccaaacctgcaaacaaacaggaagatgaagtgatgagagcctatttacaacagctaaggcaagagactggactgagactttgtgagaaagttttcgaccctcagaatgataaacccagcaagtggtggacttgctttgtgaagagacagttcatgaacaagagtctttcaggacctggacagtgaagggagcccgggcagccaccgtctccagagccctgggcagcattttccagcaagatgtacacaatcttttgcctttatttcgtaaagttttatacagaagagagaagagcatgtctttacttgaaaaactcttgatcaagaatttgggtgggagaaaagaaagtgggttatcaagggtgatttgaaattttctgcagcattaaagctggcgcttaataagaataagtaataataaagaaatttctaacattccaaaaaaaaaaaaaaaaaaaaaaaaaaaaa

SEQ ID NO: 502 - DNA, 2227 bp, Homo sapiens
taattcagaattgagtaaagaaatattttttctagtccttcatatattgaaaacttgccacatgacattgtatcgtcttcattttccagaagatgcgttggtgtgccataggtttctaacttccttgaaaatagttttttaagtcaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgtaaaacctcttgctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataagacatatgttttgattacttagggaagattcctcatttttatttgccctttatgcatttaatccacatgataggacattaaaaattaatataaagaaaaatcgtgctcatactgtacatctatttctgtgcttggaactacttgttaatagtttttatcgaagctgtcagcaataagggacataaaactgctgtattatacattgtggaattgaataaacagcctaatttttttttttctagtatagggtacttaagcatttccacttttggaagaaaagtgtattagtattttatattgcatttcatttaaaaggacagttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaaaaaaaaaaaaaaaa

SEQ ID NO: 503 - DNA, 2992 bp, Homo sapiens
taagcctcatagtctaagaaagccctcaagcaaggctaacattttggtcatctgcgagaagattgagcactcggtgtccttgctcctttcagcttcgcagcatcttctggagcagcatgagcttctcactctgactcataagtctcccaccctcataagccccactggggagtttgggggcctctattgccatgtgcctggaattattatatgctcatcactttatgatacdhcaadatttgtcdtgvctgyctttaaagttacattcgttcttccgctcaaatcctgatctggtccattaaagagtgttcgcagacaaagtttctgaaagattagagaagaatcccccccaagattgccccaacactgaactacagacaaacactattttatttaaataaggagacagctttctaaaagtatacattctctaataaaaatagtttattattttgaatgatttaatggttttctacacaatttacatcacaacatgtaaattttagcagtaacatctgattctaacagcacatcatgctattcctttcatagagccttcagagattcaatgctaaacaaatttccttagttggcatcaaggcactgatcactttagaggcttttaagaaattatttaaagatgcaaatgcctctgagtgaagtgtactatcccatcactgaagcccacaggaacaagtcctacaattttaaaaaggctcgatgggaaaaatttctcaatcctgaaatcccctagggaaggggtcagggaggaaagtgccatggttgatatttaaggaactccacagctcttaaaaaataagcacttatcccctaaccatggcaatactgcagaatgcaagttaaacttatcstgttaaacagctgcctgctgttttcctgctcccaagatgaaatgaagcaactcttctgataacgaagagatacctgtctgagscaaacgaaacattggcacacagcacagcctcctcaatccacttgatcccaactcatctctcatttatttcggcttcttttattccaggattaatgtagtgtaacattttcatttcttttcgcttttattctgcttttgtaaaagcagtattttgagatggacattgccctcttcattgtatttctcatcaattcattatttttgtggttatagcttgacaagcaattaactttaaaatggtagattccgtaactttaaattggtagctttcatttgcttaaaattttttggcatatgcagataatgttctcatcagtagtaagaatctcagggttatgcttattccccaatggaggtatgacatataatcttttctgcctttacttatcaattcaccaaggagctgttttctctgcatctaggccatcatactgccaggctggttatgactcagaagatgttatctgaaaaaagtctatagaaaaaaaaaaacakgtcccctccctcatcaacaaaagcccaccctctaagagacattcaagctgaactatcacaattcttaatcagttacaatttacaaacagataagtttaaaataaacaatttacaaaatttttgaagcataccttaacatcttgttttgcagttaaacaatggaaaagtatttctcctacactaaaaaaaaacttgcttracacacaactgaaaatagaatcttacttgataatacaaaagctaccatcagaagaaatcccttcaggatcattaagccacttcctttgctctgcagtttctatagtagttttaaattattattaaatcacctgaaaaaaattccaaaagagaaccacacactaccatatccaaacaacttttgcatttcccataattgtagttaatgtcagcccagtaggccagaccaacccccagttcaatactttccttcccccaaagctctatactttggaggaaaacagatacagtatcaaattatgacactttccttgcccaaattaatgcactggtacacccagtggctcatatttaacttcccccagcttcccaattcaaactggggggaaaaaaactaaatcattgggagttacttgccaacttggaagttgatatttctttactttttccattctaagactttaagttctctggcatgagtttatctgcaatcataaactaaacaattacctaaacccaccccaccaatcccaaccgtaacaggccactgccaactaattgccaatatttgcccctcccctttaataaaacttttaagaagtcacattattggaaaacttaacttcaacatttggcctactcaagctcttctgaagttctcctgagatgactgaatatgaaccaaagctgcactgtgctgtacttttcagcttcaactgggaatactctcccaaggataaaagcagctccagtccctgaaggtgttcgtgccaacagcacagcggtacactccttctctaacccagtttgtcaatagtactatagcatctgtggaaaatcttagaaaaaaacattttctcccccaccctctctcttccctgttaagaccatcccaaaatgcttcaagtaaaaaataacaagtttaaggggttaagcacttttaaagtctgattaagggggtggggggaaaaaagagtaactaccagccatttctccaatggacatctcttccacagacctcaacgtgagaactgctctagtttctataaactgtaaacctgtggtggtctgattatcctgatattggattttcttgttttctgttacaccttgagtcatttgcctttaggattctagacagacctaagggaaaaagaactgaaaacatattttgcccccacccccacaaaaaaaaatactgaaaactcccccccgcctcagttacacatccaaactctacatttacaaaacgaattcagggtgaggaagtaaaaacaggtcatctattcacaaaactgaaatacttcattaccccaactaaacatacaaactgcttacagattt

SEQ ID NO: 504 - DNA, 972 bp, Homo sapiens
gcatgagtagtgctctttatgaaacgcaacatgcaataatagagtaggtatggtttcagaagtcagagcagcagggtttttttgtttgtttttgttttacactatgctaatttcagacaaacagttttcaatttagaaatacaaaaacttttaaactcgaaaaatggcgaacactggttttttgggaatgtgtttttactttgcatcaagatgaatttaggagaaaatcacggtgcttttattaaatgaacttcagatatatgtaaattgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagatttgtgaaaattttgtgattgttctgtgtgataagggaagctgttggtcttgaattctttaattttgtccaaaatagttgccccaagatttaaattttgagggtggcttctttaagcagtaatttattcatgtccagtggcttccattagatgggggaacgtaccggtgttggcgccaactttaaacattcttcaaatctagttcgcggggcagacgcgttcgctccccagggcgtcgaaaatactttcagtacgatatggccgctccagaaaaggcgttcccgtgatgaaggatctcaacgaaaggctcacactaacaggggaggattacagcaccacaatactacatatcttctatatatcttcttttctaca

SEQ ID NO: 505 - DNA, 2631 bp, Homo sapiens
ggcacgaggaacaacctatttgcaaagttggcgcaaacattcctgcctgacaggaccatggacacaggttgtagagatagagatggctctggctgtgcattcagcagattctgtagatagaattaataggacttggatgggattgtggtgagagaaagtgaaatgaaagataagttctagtttggaagttttaacaactgaatgtttaaactcaaatagacacaaaatattggaagagtggcaggtttgggaggatgagacaatcaactgtttggttgagccacgttaggtttgaaatgtctacgggatcccgtggggagaggttatatcagactggagcaccagagagaggccaaggctgatagtttagatgaaaagagagcatgatattttaagccctgagactggataatatcacctatagaaagactatatagagataagagaggtggggaacaagtaaaagctgcgggacactcctaaatttagagtcaaatttagagcagaaaatactagcaaaggggactgaaaagcggtggccaattgagcttcaaatgcaagtgaaagtgtgttgtgtgtacatttatcatctcatggcacaggaaaaacgtgatttaaggagaaggaagcgatccaatgggaagaagagatccaatggatcctctatcacgaagatattgagataagaaccaatatggatttgcacccactgcatttgcagccttgaggtcataagcatcctcaggaaaatgcaccaggtgctgctggcaagatggaaaccaacttctccactcctctgaatgaatatgaagaagtgtcctatgagtctgctggctacactgttctgcggatcctcccattggtggtgcttggggtcacctttgtcctcggggtcctgggcaatgggcttgtgatctgggtggctggattccggatgacacgcacagtcaccaccatctgttacctgaacctggccctggctgacttttctttcacggccacattaccattcctcattgtctccatggccatgggagaaaaatggccttttggctggttcctgtgtaagttaattcacatcgtggtggacatcaacctctttggaagtgtcttcttgattggtttcattgcactggaccgctgcatttgtgtcctgcatccagtctgggcccagaaccaccgcactgtgagtctggccatgaaggtgatcgtcggaccttggattcttgctctagtccttaccttgccagttttcctctttttgactacagtaactattccaaatggggacacatactgtactttcaactttgcatcctggggtggcacccctgaggagaggctgaaggtggccattaccatgctgacagccagagggattatccggtttgtcattggctttagcttgccgatgtccattgttgccatctgctatgggctcattgcagccaagatccacaaaaagggcatgattaaatccagccgtcccttacgggtcctcactgctgtggtggcttctttcttcatctgttggtttccctttcaactggttgcccttctgggcaccgtctggctcaaagagatgttgttctatggcaagtacaaaatcattgacatcctggttaacccaacgagctccctggccttcttcaacagctgcctcaaccccatgctttacgtctttgtgggccaagacttccgagagagactgatccactccctgcccaccagtctggagagggccctgtctgaggactcagccccaactaatgacacggctgccaattctgcttcacctcctgcagagactgagttacaggcaatgtgaggatggggtcagggatattttgagttctgttcatcctaccctaatgccagttccagcttcatctacccttgagtcatattgaggcattcaaggatgcacagctcaagtatttattcaggaaaaatgcttttgtgtccctgatttggggctaagaaatagacagtcaggctactaaaatattagtgttattttttgttttttgacttctgcctataccctggggtaagtggagttgggaaatacaagaagagaaagaccagtggggatttgtaagacttagatgagatagcgcataataaggggaagactttaaagtataaagtaaaatgtttgctgtaggttttttatagctattaaaaaaaatcagattatggaagttttcttctatttttagtttgctaagagttttctgtttctttttcttacatcatgagtggactttgcattttatcaaatgcattttctacatgtattaagatggtcatattattcttcttcttttatgtaaatcattataaataatgttcattaagttctgaatgttaaactactcttgaattcctggaataaaccacacttagtcctgatgtactttaaatatttatatctcacaggagttggttagaatttctgtgtttatgtttatatactgttatttcactttttctactatccttgctaagttttcatagaaaataaggaacaaagagaaacttgtaatggtctctgaaaaggaattgagaagtaattcctctgattctgttttctggtgttatatctttattaaatattcagaaaaattc

SEQ ID NO: 506 - DNA, 1379 bp, Homo sapiens
ggcacgaggatctttcccagttgttccgccccctacccccgcctcccgcaccgcgcccctctccggctgccctctccgcgtggggcaaggctccgagggcagcattcagtagccatttagctttggaaggagaggtgattcgaatggcccggctcctcctgtcaccatgccaggcactttggccgcgcaggtgctgacctgaacctggttcatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaacgcttgagctggaagtaagcccagatccagccagccaaattctagagcatactcaaggagctgaaaaactggttgctgaacttgaaggagactctcataagtctcatggatcaaccagtcagatgccagaggcccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaaccctgaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagagaaaaaaaaaaaaaaaaaaaaaaaaaaaaaaaaaaaaaaaaaa

SEQ ID NO: 507 - DNA, 2059 bp, Homo sapiens
gtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcacactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcaggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcggctgcggcagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaaaaaaaaaaaaaaaaaa

SEQ ID NO: 508 - DNA, 1028 bp, Homo sapiens
aatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtaccgtgagccaagatcacgccactgcctccaggctgggcaacagagtgagactccgtctcaaaaattaattgcattttgttagaaaggtcacaatggctattaaatttacatctctatttcatcttcaaggagatccggggataatatgctatgcggcttgacctgtttgacaccaccctctttggaataatggcggccctcacttaaggcaccatatggccccaatatatgagcaactggagcaactacccaaagtatacagacaaaaaaatttttcacagaacttcttttgagggcccttgacaaaagggaggttacctacacaacacaaagttggccccattaaattaacggccatcacacccacgactgacggtgatcaaacaaattcacagcacagacaccgcgcaacaacgcaacttctccagcaggacatcgactc

SEQ ID NO: 509 - DNA, 1406 bp, Homo sapiens
cctctgcggcgtcactgggagcccgacggaaaactgcgctaaaggcttgtctttcccctgcccgaccgaaggagccgaccttgcctgcgctacagcttccttattttcgtcgcctgttctcctgatcctgcgtgttctaaaaaccccttaggctttccatgggttcccagaccatggcggtggcgctgcccagggacttgcggcaggacgccaacctggcaaagaggaggcacgcggagctgtgcaggcagaagcgggtcttcaacgccagaaacaggataattgggggagacactgaagcctgggatgttcaagttcatgaccagaagataaaagaagctactgaaaaagctagacatgaaacctttgctgctgaaatgaggcaaaatgacaaaatcatgtgcatattggaaaaccggaaaaagagggataggaaaaatctctgtagggctatcaatgacttccaacagagctttcagaagccagaaactcgccgtgaatttgatctgtccgaccccctagcccttaagaaagatcttccagcccggcagtcagataatgatgttcggaatacgatatcaggaatgcagaaattcatgggagaggatttaaacttccatgagaggaagaaattccaagaggaacaaaacagagaatggtctttgcagcagcaaagggaatggaagaacgcccgtgctgaacaaaaatgcgcagaggccctctacacagagacaaggctgcagtttgacgagacagccaagcacctccagaagctggaaagcaccaccagaaaggcagtttgtgcatctgtgaaagacttcaacaagagccaggccatcgagtcagtggaaaggaaaaagcaagagaaaaagcaagaacaagaggacaacttggccgagatcaccaacctcctgcgtggggacctgctctccgagaacccgcagcaggcagccagctccttcgggccccaccgcgtggtccctgaccgctggaagggcatgacccaggagcagctggagcagatccgcctagtccagaagcagcaaatccaggagaagctgaggctccaggaagaaaagcgccagcgagacctggactgggaccggcggaggattcagggggctcgcgccaccctgctgtttgagcggcagcagtggcggcggcagcgcgacctgcgcagagctctggacagcagcaacctcagcctggccaaggagcagcatttgcagaaaaaatatatgaatgaagtctatacaaatcaacccacgggagactatttcacacaatttaatacaggaagtcgataatgaggaacacacccttgttcccgtcattcacgtataaagagtggctaccttaaaaaaaaaaaaaaaaaaaaaaaaaaaaaaaaaaaaaaaaaaaaaaaa

SEQ ID NO: 510 - DNA, 4357 bp, Homo sapiens
atagtcaccagaagctggaagagtcaaaggacacattctcccctcaagccccagtgggagcacggcccagctggattttggacttctggcctccagaactagacagggcctcacggtgtcacccagggtggaatacagtggtgtgatcatagctcactgcagcctggaattcctgggctcaagcaaccctgccacctcagccttccaagtagctaggactacagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgagcggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagttatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgtactgctgcaaaaaaaaaaaaaaaaaaaaaaaaaaa

SEQ ID NO: 511 - DNA, 5476 bp, Homo sapiens
ggacggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagataataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgactttgactgaactccgggtccttcttgagcagatgggcagcctgccctgcgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccaacttctatctgtgtgtgtgggcaggtgccagctggggtgggacttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctttgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcgctgttgccgcagttgactggccctgtgttggagctgcctgaggcaatccgggctcccctggaggagctcatgatggaagggggcctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcctatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttgggaaaaaaaaaa

SEQ ID NO: 512 - DNA, 297 bp, Homo sapiens
ttacgagcaagagttcatcacggaccagccgtgaggcagggcacacgcgggtcggcggcgatgatgtcccccgcgaaggggacaacgaaaacaagaggccgccggccgcggccacggatgcgtagcggttacacaatgtttggttgagcgttttgtttcatcgtcgtggtggttttgttgttctctgtatatatcgtgtggtggctttatcgtcatcattattatcatcattcttgtttccatcatcacgatgagttttctccgttttcctctcctccagtggtagtcgtgtatcat

SEQ ID NO: 513 - DNA, 2294 bp, Homo sapiens
aaaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggtctgaggaagccttgccgggtggggtgtggcaggctgggggctgggatgtgatgggtgtctctgctcaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacggggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggaggccagggccggcttcaacagcagctccacctgtggttgtgcccacccgtcgcatcaggcaagatggcccatggtggtctagtcctgtggctaatgccctgatgagtgtcactggcccagtcctagatgccccgctcttctcccctgctcatgggtgctcctcctcagggcctccattgagcagctggggctgggcagccggcgcaaggcagcactggtggtgccggcatttgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatc

SEQ ID NO: 514 - DNA, 1542 bp, Homo sapiens
ctcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaattacttgcagctggacagctagctgatgctttatctcagtttcatgctgccgtagatggtgaccctgataactatattgcttattatcggagggctactgtctttttagctatgggcaaatcaaaagctgcacttcctgatttaactaaagtgattcaattgaagatggacttcactgcagcaagattacagagaggtcacttattactcaaacaaggaaaacttgatgaagcagaagatgattttaaaaaagtgctcaaatctaatccaagtgaaaatgaagaaaaggaagcacagtctcaacttataaaatctgatgaaatgcagcgtttgcgttcacaagcacttaacgcttttggaagtggagattatactgctgctatagccttccttgataagattttagaggtttgtgtttgggatgcagaactacgggaacttcgagctgaatgttttataaaagaaggagaacctaggaaagctataagtgacttaaaagctgcgtcaaagttgaagaatgataatactgaagcgttttataaaataagcacactgtactaccaactaggagaccacgaactgtccctcagtgaagttcgggaatgtcttaaacttgaccaggatcataaaaggtgttttgcacactataaacaagtaaagaaacttaataagctgattgagtcagctgaagagctcatcagagatggcagatacacagatgctaccagcaaatatgaatctgtcatgaaaacagagccaagcattgctgaatatacagttcgttcaaaggagaggatttgccactgcttttctaaggacgagaagcctgttgaagctattagggtttgttctgaagttttacagatggaacctgacaatgtgaatgccctgaaagatcgagcagaggcctatttgatagaggaaatgtatgatgaagctattcaggattatgaaactgctcaggaacacaatgaaaatgatcagcagattcgagaaggtctagagaaagcacaaagattattgaaacagtcgcagaaacgagattattataaaatcttgggagtaaaaagaaatgccaaaaagcaagaaattattaaagcataccgaaaattagcactgcagtggcacccagataacttccagaatgaagaagaaaagaaaaaagctgagaaaaagttcattgatatagcagctgctaaagaagtcctctctgatccagaaatgagaaagaagtttgacgacggagaagatcctttggatgcagagagccagcaaggaggcggcggcaaccctttccacagaagctggaactcatggcaagggttcaatcccttcagctcaggcggaccatttagatttaaattccacttcaattaa

SEQ ID NO: 515 - DNA, 4346 bp, Homo sapiens
gcgtgggcgccagaaagcggaacctcccgggccagtcgcgcggtggtcaccctcttgggagctggggaggaggctgcggaggctggcccggctccttcgggcgtcgcttcccggaccgggtgcgcggggtcccccggaacgtgtgttccaggtcctcccgcgccagtgttcgcagtccccgcctggtcgcggcggcgcctcgggcgcgggtgcaggcgcgcggcgcgcaggcggggggcgctgtggtcttggcgcggggaccgagccgctcggccagacccgcctcttttccctccccgccagcccgcccgcctgcccgccccccacgcgtcgtgtcgccgggaagccgggcggagacagagcgcttgggatccacggcgctcggaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacataggtctgtatggctgtatttgctgttgattcagactttcacaccattaatggggaaaagcgtggccacaaaaacagatgctaggaagcttggcttcctcttcttgttgacccttttttgaaccaacatcttttttattatattcagagtatgtttttaagtgtatcttaatatatacattttttaggacatcttaaatctaaacaaaaaataaaatgaacatctcttgaaacctgttaaaacaaccagttaaagccacagatggctttcagggcagtagcagcagaggccagtggactctgaggactcctgaggggcggggcgtgtagccagccaggtgcatgccgggaccatggcccccatacttggctgcttcctgtgacagtgaaatacatccttcaaggtggcagctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggcatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcacttcaaagctaaaaaattgttaaacttgcagcttggtattgcagagaagattttataagaattttgctttagagaatgccactttggctgaactacaagtgtaggccaccattataatttataaatacagcatacttcaaaactgtttgttatctcttgttaccatgtatgtataaatggaccttttataaccttgttctctgcttgacagactcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatgaataaaaaaaaaaaaaaaaaaaaaaa

SEQ ID NO: 516 - DNA, 2236 bp, Homo sapiens
cccgagtctcaggagcctgccttacagcaggaggtgcaggcctcgtcacctgcagaggtgcctgtgtctcagcctgaccccttgccagcttctgaccacagttacgagctgcgcaatggtgaagccattgggcgggatcgccgggggcgcagggcccggaggaacaacagtggagaagcaggcggggcagccacacaggagctcttctgctcagcctgtgaccagctctttctctcaccccaccagctacagcagcacctgcggagtcaccgggagggcgtctttaagtgccccctgtgcagtcgtgtcttccctagcccttccagtctggaccagcaccttggagaccatagcagcgagtcacacttcctgtgtgtagactgtggcctggccttcggcacagaggccctcctcctggcccaccggcgagcccacaccccgaatcctctgcattcatgtccatgtgggaagacctttgtcaaccttaccaagttcctttatcaccggcgtactcatggggtagggggtgtccctctgcccacaacaccagtcccaccagaggaacctgtcattggtttccctgagccagccccagcagagactggagagccagaggcccctgagccccctgtgtctgaggagacctcagcagggcccgctgccccaggcacctaccgctgcctcctgtgcagccgtgaatttggaaaggccttgcagctgacccggcaccaacgttttgtgcatcggctggagcggcgccataaatgcagcatttgtggcaagatgttcaagaagaagtctcacgtgcgtaaccacctgcgcacacacacaggggagcggcccttcccctgccctgactgctccaagcccttcaactcacctgccaacctggcccgccaccggctcacacacacaggagagcggccctaccggtgtggggactgtggcaaggctttcacgcaaagctccacactgaggcagcaccgcttggtgcatgcccagcacttcccctaccgctgccaggaatgtggggtgcgttttcaccgtccttaccgcctgctcatgcaccgctaccatcacacaggtgaatacccctacaagtgtcgcgagtgcccccgctccttcttgctgcgtcggctgctggaggtgcaccagctcgtggtccatgccgggcgccagccccaccgctgcccatcctgtggggctgccttcccctcctcactgcggctccgggagcaccgctgtgcagccgctgctgcccaggccccacggcgctttgagtgtggcacctgtggcaagaaagtgggctcagctgctcgactgcaggcacacgaggcggcccatgcagctgctgggcctggagaggtcctggctaaggagccccctgcccctcgagccccacgggccactcgtgcaccagttgcctctccagcagcccttggaagcactgctacagcatcccctgcggcccctgcccgccgccggggtctagagtgcagcgagtgcaagaagctgttcagcacagagacgtcactgcaggtgcaccggcgcatccacacaggtgagcggccatacccatgtccagactgtggcaaagcgttccgtcagagtacccacctgaaagaccaccggcgcctgcacacaggtgagcggccctttgcctgtgaagtgtgtggcaaggcctttgccatctccatgcgcctggcagaacatcgccgcatccacacaggcgaacgaccctactcctgccctgactgtggcaagagctaccgctccttctccaacctctggaagcaccgcaagacccatcagcagcagcatcaggcagctgtgcggcagcagctggcagaggcggaggctgccgttggcctggccgtcatggagactgctgtggaggcgctacccctggtggaagccattgagatctaccctctggccgaggctgagggggtccagatcagtggctgactctgcccgacttcctctttggcacctccattccctgttgctgaaggccctccagcatccccttaagcatctgtacatactgtgtcccttcctcttcccatccccaccaccttgtaagttctaaattggatttattctctcgtgaggggggtgctctggggtccttgacacacataaaggtgcccccccaccttccacctcttagcactggtgaccccaaaaatgaaaccatcaataaagactgggttgccaaaaaaaaaaaaaaaaa

SEQ ID NO: 517 - DNA, 1900 bp, Homo sapiens
acaactctcagaggagcattgcccgtcagacagcaactcagagaataaccagagaacaaccagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacagggaattatttactggaaagtgtcaataagctgtttggtgagaagtctgcgagcttccgggaagaatatattcgactctgtcagaaatattactcctcagaaccccaggcagtagacttcctagaatgtgcagaagaagctagaaaaaagattaattcctgggtcaagactcaaaccaaaggcaaaatcccaaacttgttacctgaaggttctgtagatggggataccaggatggtcctggtgaatgctgtctacttcaaaggaaagtggaaaactccatttgagaagaaactaaatgggctttatcctttccgtgtaaactcggctcagcgcacacctgtacagatgatgtacttgcgtgaaaagctaaacattggatacatagaagacctaaaggctcagattctagaactcccatatgctggagatgttagcatgttcttgttgcttccagatgaaattgccgatgtgtccactggcttggagctgctggaaagtgaaataacctatgacaaactcaacaagtggaccagcaaagacaaaatggctgaagatgaagttgaggtatacataccccagttcaaattagaagagcattatgaactcagatccattctgagaagcatgggcatggaggacgccttcaacaagggacgggccaatttctcagggatgtcggagaggaatgacctgtttctttctgaagtgttccaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtaccctccatgcccttctgtaataaatatctggaaaaaacattaaacaataggcaaatatatgttatgtgcatttctagaaatacataacacatatatatgtctgtatcttatattcaattgcaagtatataataaataaacctgcttccaaacaac

SEQ ID NO: 518 - DNA, 1812 bp, Homo sapiens
tagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgag

SEQ ID NO: 519 - DNA, 330 bp, Homo sapiens
  misc_feature (113)..(113): n is a, c, g, t or u
  misc_feature (270)..(270): n is a, c, g, t or u
tttttttttttttttttggccagatcaatagctaggtagaaaccttttcaactgggacaggagacaccatcctttgggtgttgttctctaccttcccatgcaaaaggcagtanaagatgtggaggacagagaggaagagctgagagtcctggaaagccaaaaggctacacacatcacataaactgattggcctcagggaaaagactgaggttcaaagaggtgacagactccatcaaggtgacatgactggctggttgcctgcagaagtanatgcaggtcccaggtccagctctggtctcaattacagcccaaagcctatctccagccaca

SEQ ID NO: 520 - DNA, 348 bp, Homo sapiens
acgtccctggtagacggggtagggggatctaccagcccagggatcgcgtctttcgccgccacgctgcttcaccgatatccaataaacccatcccctcgccacgacgtctccgcgtatctttgtagcctcaagaatccgtccccacgtccacccatcccgagcactccacacgccataacaaaccacggacacgacaaatgcatgcaaacttctcatttattgtgtctactactctgtgttgctacagggagtgaagagggtgaaggcaaagaaaaaaaaaaggaacaaaataatagattagcagaaggaataatccgtgcgaccgagcttgtgcttcttttcttataa

SEQ ID NO: 521 - DNA, 862 bp, Homo sapiens
agcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcagctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagaractgtttgggagcttctggggagccctgctagttgtctcagtkatgtctgtkggacctccagtcccttgagaccccacgtcatgtagagaagttaacggcccaagtggtgggcaggctggcgggacctggggaacatcaggagaggagttcagagcccacgtctactgcggaaaagtcaggggaaactgccaaacaaaggaaaatgccccaaaggcatatatkctttagggcctttggtccaaatggcccgggkgggcactcttccagatagaccaggcaactctccctccc

SEQ ID NO: 522 - DNA, 315 bp, Homo sapiens
aggtgaatgatgactacaataacattgcaactatttctttcctggcatagggaggtaataagaaactaaatgatcgcatggtacatgcttgtattatatagatgggtttaggaatctataaagtatggaggtaggaagacaccatatgtccaggatcaaaacattcctcatattgaggtagtctagtgaagctgtttcatgtagctgctttaggaagtggtttaaggaagcttactcccacttcaagttaagcaccaaagcaatcactaattctggagcacaggaagactgctatctcatcattcacctttgcag

SEQ ID NO: 523 - DNA, 972 bp, Homo sapiens
atgacaccgacgacgacgaccgcggaactcacgacggagtttgactacgatgaagacgcgactccttgtgttttcaccgacgtgcttaatcagtcaaagccagttacgttgtttctgtacggcgttgtctttctcttcggttccatcggcaacttcttggtgatcttcaccatcacctggcgacgtcggattcaatgctccggcgatgtttactttatcaacctcgcggccgccgatttgcttttcgtttgtacactacctctgtggatgcaatacctcctagatcacaactccctagccagcgtgccgtgtacgttactcactgcctgtttctacgtggctatgtttgccagtttgtgttttatcacggagattgcactcgatcgctactacgctattgtttacatgagatatcggcctgtaaaacaggcctgccttttcagtattttttggtggatctttgccgtgatcatcgccattccacactttatggtggtgaccaaaaaagacaatcaatgtatgaccgactacgactacttagaggtcagttacccgatcatcctcaacgtagaactcatgcttggtgctttcgtgatcccgctcagtgttatcagctactgctactaccgcatttccagaatcgttgcggtgtctcagtcgcgccacaaaggtcgcattgtacgggtacttatagcggtcgtgcttgtctttatcatcttttggctgccgtaccacctaacgctgtttgtggacacgttaaaactcctcaaatggatctccagcagctgcgagttcgaaagatcgctcaaacgtgcgctcatcttgaccgagtcgctcgccttttgtcactgttgtctcaatccgctgctgtacgtcttcgtgggcaccaagtttcgcaagaactacactgtctgctggccgagtttcgccagcgactcttttcccgcgatgtatcctggtaccacagcatga

SEQ ID NO: 524 - DNA, 949 bp, Homo sapiens
tttctcgccacggcacaacgccaccttgggcaaacctaattccagtcttggatgccaccttgctgacgacaaggcacttccttacaatgagcctggaattctaagcagcagcttcacaatctgcaattgcacgtttctgccctttacaataaagaaacacacactttcctttcaccacccacacccaccaaaaataccaccacactccaacacaccccacgaagaaagcgagaaagcccaaaactgggccccccaccacaaccgcacccccacgaatctgtcatacatccacaagacacccgggccctctgagcacccacggcgaacggccgccaagccgccacccccctcccaggcggcagcccccacatgcgccacgtcgtacatcacgtcacccaacgccaccgacctatgcgcaatcgcgcgcatagccccgtactcgggccagcagccccaccccagccagccacactgctccccctcgcacaccacaccaagatcgcgcgacccaacgcacccactccgcaccacaccccacaccacccccaccccgctcgaccagcatgtgtcacaaccccgtacccgcaccctgagtaccacgaaacggacaggctaacgacgcgaagtacctcacccacccgaccgaacgcgatccacggtcccgtaagcgctaattccagactacacccccatagctcgccgcaatggtctgcacgtccaccccacaccaacagagatcactacagaaatatgcctccaaccccgcccacgttaaactccccactccacacgcagcaatgtcactcggcaccgcgcctttcacggtgtgacaggtcttctccatagatgtcggatcggcctccttactacctccccccttacgaaagagtacacactccacaaccacagacctccgcccaaggcgccgcccgcgcgccccgcgcacgtg

SEQ ID NO: 525 - DNA, 2298 bp, Homo sapiens
aatagaagatcgctcgggaattcttactctcgataaagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttagatcttggttctggagatgaaaaagtgcggaaaagtgatgttaaaaagtttctgactccaggatattcaacctctggccacgtagaattatacacaattagtgtagagaggggaatgtcatgggaggaagctaccaagatttgggctgagctgacaggaccagacgatggcttttacttgtcattgcaaataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtcgtctcagatgatgccctgatgcactggttagatcagtataattcatctgcagatacttgtactcatgcttattggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttcttttttttctttttttttttttttgcttccacaggttgcactattgaaaaatcgagattgtataaacctggtaaaaagctgcaagatgccaaaatcttgtagatgtcaaataaaaagttattatact

SEQ ID NO: 526 - DNA, 618 bp, Homo sapiens
cttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggt

SEQ ID NO: 527 - DNA, 2640 bp, Homo sapiens
gggcggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttcgcagactacttccccgagtgcaaatggtcaagaaaaggcttcatccggacgaggtggtgattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtctgtcgtggagacgctctcagcaaaaccaccgatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagccccacatacctcactgtctcgtctgtctatgtgacattaagtagaaatattggtttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgtttttattgatttttactttagaacactacagagttcctgggaccggggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtga

SEQ ID NO: 528 - DNA, 743 bp, Homo sapiens
agcgtgggtaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtagacactccagggctctttgacaccaaggagagcctggacaccacctgcaaggaaatcagccgctgcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaaggagtgcgggaaccgctgctgtgcctttagcaacagcaagaaaaccagtaaggcagagaacgaaagtcaagtgcagcgagttgggtggaagctgatagagcaacacatggtgcagtgcaacgaacgggccttacttttctgatgacctata

SEQ ID NO: 529 - DNA, 346 bp, Homo sapiens
cttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaaaaaaaaaaaaaaaaaaaaaaaaaaaaaaaaaaaaaaaaaaaaaaaaaaaaaaaaa

SEQ ID NO: 530 - DNA, 397 bp, Homo sapiens
ctatgctgcctgggctagtctcaaactccttgcctcaaatgatcctcccacatcagtctcccaaacagttcaacctacacgaacaggcaaccatgcctggtgtatttattaaaatgtagctactagaatatttaaaattcacatgtgcctcacatattatttcttagagaattgcctcatttttgaaatctcaggctgcctgctctaaaacctggatgtgccaggaaagtaaaaaatctgaaattttaaaataattgtcattatattgcttccatgtatgaataacacatatatatttttcataaatacaaataatcttacacacaaatgaaaatgcaagtattttacagtcagggccagtgtccagtgcatgaaggaagccctgccagaaaaggat

SEQ ID NO: 531 - DNA, 1236 bp, Homo sapiens
ttactgagacttgttcctcaggtcctggatggctgcctcgatggccaggctcagggtgtccaggtcttcgggaggggtctcggtgggctgctcaaactgccccacggcgtaggccttcgcggccgtctcgtagataggcagcatgaacccaccctggttggtggagaagatgcgcaccatgacctgtttgggaaacttttgcatcaggggcaggcacaggttgagagcgcccaacaggtccacgggggtggcagcgtggatgatcatgttgcggtaatcggaggaacgggggcataattggtgggtgtgcaattctttgaggctccacgcggccttgacgccttcgttacaagcatcggctgtgcgctgcgccacttcgggtggatgtgtcacgggcatggtgtgctccatgaggaagggagtggagagggccaggttgcacatggtgcccaggcgacaccgcaccgcatccacctcactcttcacctcatgattgcgggtgtagataatctggatgcccttgttgttcacctgcatggttttgcaggctttgatggcctcatctaacacctggtgcatactgggaatcgtgaagggcaggttcttgtactcaagagagcgattggtgttgcggaacatgcggctcacctcgtcaatcttgacgcgaccccgccgagtctgcacgttgggtgtgcagaagggggtgttcttatctttcatgatattgcgcaccttctcgttgtccaactcggagatgcgtttgctcttcttcttgcggggtccggtgctcgccccgccgctgctctgatggccgcagctcagcagagaggaggaggccgcgccaccaaaaccgccgcgcccatggtggctcgaggtcacggatgctcctccgccactgctgcatttcatctcctcggactcactctccgagtccgaagccgaactgcaggaggaggaagacgaagaggaactatcttcatcgggccggcccaagggatcgggaagaggagggtggttcatctgggagagcgggtgcgtgggagaggtcactcgcggcgtgccgctgccggtggaaggggaagacgcggtagcaccgcgggtttcgacttcttcaccctgttcttcctcgctatcagagatcacgatacagccggcggtatcgataatcttgttgcggtactggatggtaaagtcgggctcgggcttgatgtcttcctgtttgatgaggggcagcat

SEQ ID NO: 532 - DNA, 2034 bp, Homo sapiens
aaaccttggccatggtcacttcctcttttccaatctctgtggcagtttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcaagacccccacagatttggtcacacaccagtacaagcaagactcagctgcctggccaaggacaactctatctatgtcttggcaaatttgggggacaaaaagccatgtaattcccgtgactccacatgtcctcctaatggctactttcaatacaataccaatgtggtgtataatacagaaggaaaactcgtggcacgttaccataagtaccacctgtactctgagcctcagtttaatgtccctgaaaagccggagttggtgactttcaacaccgcatttggaaggtttggcattttcacgtgctttgatatattcttctatgatcctggtgttaccctggtgaaagatttccatgtggacaccatactgtttcccacagcttggatgaacgttttgccccttttgacagctattgaattccattcagcttgggcaatgggaatgggagttaatcttcttgtggccaacacacatcatgtcagcctaaatatgacaggaagtggtatttatgcaccaaatggtcccaaagtgtatcattatgacatgaagacagagttgggaaaacttctcctttcagaggtggattcacatcccctatcctcgcttgcctacccaacagctgttaattggaatgcctacgccaccaccatcaaaccatttccagtacagaaaaacactttcaggggatttatttccagggatgggttcaacttcacagaactttttgaaaatgcaggaaaccttacagtctgtcaaaaggagctttgctgtcatttaagctacagaatgttacaaaaagaagagaatgaagtatacgttctaggagcttttacaggattacatggccgaaggagaagagagtactggcaggtctgcacaatgctgaagtgcaaaactactaatttgacaacttgtggacggccagtagaaactgcttctacaagatttgaaatgttctccctcagtggcacatttggaacagagtatgtttttcctgaagtgctacttaccgaaattcatctgtcacctggaaaatttgaggtgctgaaagatgggcgtttggtaaacaagaatggatcatctgggcctatactaacagtgtcactctttgggaggtggtacacaaaggactcactttacagctcatgtgggaccagcaattcagcaataacttacctgctaatattcatattattaatgatcatagctttgcaaaatattgtaatgttatagggcgtctctttatcactcagcttctgcatcatatgcttggctgaatgtgtttatcggcttcccaagtttactaagaaactttgaagggctatttcagtagtatagaccagtgagtcctaaatattttttctcatcaataattattttttaagtattatgataatgttgtccatttttttggctactctgaaatgttgcagtgtggaacaatggaaagagcctgggtgtttgggtcagataaatgaagatcaaactccagctccagcctcatttgcttgagactttgtgtgtatgggggacttgtatgtatgggagtgaggagtttcagggccattgcaaacatagctgtgcccttgaagagaatagtaatgatgggaatttagaggtttatgactgaattccctttgacattaaagactatttgaattcaaaaaaaaaaaaaaaaaaaaaaaaaaaaaaa

SEQ ID NO: 533 - DNA, 4500 bp, Homo sapiens
cgggtggttgagtggaagcggtcgccatgtccgcggggagcgcgacacatcctggagctggcgggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaagcttcaggctcctggcaaaggcctaactagcaataaaagcaaggatgacctggtggtagctgaagtagaaattaatgatgtgcctctcacatgtaggaacttgctgactcgaggacagactcaagacgagatcagccgacttagtggggctgcagtatcaactcgagggaggttcatgacaactgaggaaaaagccaaagtgggaccaggggatcgtccattatatcttcatgttcagggccagacacgggaattagtggacagagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcagggatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcagtcaccccaaaccagaaggcctggctgctgccaagaagctttgtgagaatcttttgcaaacagttcatgctgaatactctagatttgtgaatcagattaatactgctgtacctttaccaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccagcatggacccattcatatgactaatttaggtacaggcttctccagtcagaatgagattgaaggtgcaggatcgaagccagcaagttcctcaggcaaagagagagagagggacaggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaatccaacctctataatctgttggccagtgaaaatacttttgggctgggcacggtggctcacgcctgtaatcccagcactttgggaggccaaggtgggcggataacctgaggtcaggagtttgagaccagcgtggctaacacggtgaaaccccgtctctactaaaaatagaaaaattaagctgggcatggtggtgcatgcctgtaattccagcggcttggaaggctgaggcaggagaatcacttgaacttgggaggtggaggttgcagtgggccgagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttcttttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattc

SEQ ID NO: 534 - DNA, 594 bp, Homo sapiens
  misc_feature (15)..(64): n is a, c, g, t or u
ggggacattagtttnnnnnnnnnnnnnnnnnnnnnnnnnnnnnnnnnnnnnnnnnnnnnnnnnntgtgtctcatgaataggaaagaaagcagatgtaaagagttacataaaagcaaacagcttgctctggtttctgggtctaacaattacgacttaaacaatggagccaaagaaaaatacattagatgattctcaacctggaaagcaagactgcaaattataaccacaaaaacaaagatctactgtctcccagataccggaaatggtaacccggatatttgaggcttccaaggcaggaagataaaggagaatcagacccctgagcagggactctggagcagcactccaggaccctgcctagagactaagcctcaggtggagcagtgaggtagacatctgctcacaccagtttcctctcacagatgtacacagattggggtgttgggtgagggcctgatgggggaaaggaaagagagaactgctataggtgaatctctctgtggcttgttgtgggaccctgcgccctttaaattagggcatattttacaaaaacttattattctacacagcccttcttgggcctttacagaacga

SEQ ID NO: 535 - DNA, 1721 bp, Homo sapiens
cgggtgtagatttcacaacccagggggcggagccaggatgatgaccccgccccctccctaaataattctcccgggagggacacggaagcagcaaccgggatgggacggggagagaggaggcactactggggacctaagctggttctcaaatgcctctccttttcccctccaagcctcccaggcttcctatggtccctaagtcccgggttctcagcgtgacattccagagcaaacacagctccccattactctataccaggcactggcatggattaatttatctaatcacaacatcccagtaagatatgccctgcctctcctgctcacactctatggctggcattcacctgtggggccaggtcgaaactcctggcttggccgtcaatgccttactggagctgctctgctaacctcctgctgcttcctctcggacctcgattcagccatcatgaatttaccagcatagagcatgtgattccacacctccaagcttttgcacatgctgctccctgccagcgaccctcttttggccggcctaccccgggaccctgactactctgtgtcctgcctctactcacctccctcaccctccagcatgtgtttgcctgctaacatgaagtgtgacaagtactggggctcttcctcggacaaggctctggaagcgtacagctcactggtccaggactccagagccagagaccttgggatgccctgcttctggggacacagtgaggactgcagactgcaggccagggtggggctcagggccttcgccacatgaggctgccccctcccccagtccagacctgcagaagcagtgctgtaatgaccaggacattttgaagaggcatcacaacgtatctaagaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactgtgaccaggacctctcccagccacctttcagcaagagcggccgc

SEQ ID NO: 536 - DNA, 526 bp, Homo sapiens
cgcctgcggtcccccaggagttcaaggctgtggtgagctatgattgtaccactgcactcgtgcttgagcaacagagcaagaccgcatctcaaaaacacaaaaacaacacctatcctcttgctttgctgccagaaaagacaaaaagcacaaataaacaagcacctgacagcgttataggtggagaccgagttctatgagtgcagtaaagtggggcacggcacagagatggagctgtactctagacagggtgttctgaatcaggaatggacttacaaaacatctgcagtcagaaattcacatacagactatagtagatcaaaagctcattttaaactatcaatgaggaaaaaagcaattcatttacataacattctctttccaactcaaacatcaggtacaaattgctttcttttagcatatgccagaaatctgtcattacacaatagcttagcaagtgtgacacaagatactgccactttctctacacaaagacccacccaaacaccagctttgtttaaaacattac

SEQ ID NO: 537 - DNA, 1837 bp, Homo sapiens
tttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 538 - DNA, 1697 bp, Homo sapiens
ggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactcagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatcccaccagtggggaaacattagaagaaaatgaagctggggactgaggtgcgtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaacgaaaaaaagaaattgaataataaaatcaggagtcaaaattcatcgtcttcaaggcccctctttctagccttttctactactctctgcttggtcaaggtttgtgccccactacagaacagggctaaattagccaccaccactgaaaactcagccgaatttttttataccactctgacgtcagcatttttt

SEQ ID NO: 539 - DNA, 1283 bp, Homo sapiens; identical to SEQ ID NO: 495

SEQ ID NO: 540 - DNA, 6417 bp, Homo sapiens
gcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggatgatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaaggaaaaaaccaaaagcataaaaaaccacagcaaatttcttgatgaaaattgaaaataaaagtttccttgt

SEQ ID NO: 541 - DNA, 1680 bp, Homo sapiens
cacggcagccctacactcggcctggaagaattgtttttcttctctggaaaggtgaacatttatagcatttatttcccaaatctgttaacatggcaaaatatgtcagtctcactgaagctaacgaagaactcaaggtcttaatggacgagaaccagaccagccgccccgtggccgttcacacctccaccgtgaacccgctcgggaagcagctcttgccgaaaacctttggacagtccagtgtcaacattgaccagcaagtggtaattggtatgcctcagagaccagcagcatcaaacatccctgtggtaggaagcccaaacccacccagcactcactttgcctctcagaaccagcattcctactcctcacctccttgggccgggcagcacaacaggaaaggagagaagaatggcatgggcctgtgccgtctttccatgaaggtctgggagacggtgcagaggaaagggaccacttcctgccaggaagtggtgggcgagctggtcgccaagttcagagctgccagcaaccacgcctcaccaaacgagtcagcttatgacgtgaaaaacataaaacggcgcacctacgatgccttaaacgtgctgatggccatgaatatcatctccagggagaaaaagaagatcaagtggattggtctgaccaccaactcggctcagaactgtcagaacttacgggtggaaagacagaagagacttgaaagaataaagcagaaacagtctgaacttcaacaacttattctacagcaaattgctttcaagaacctggtgctgagaaaccagtatgtggaggagcaggtcagccagcggccgctgcccaactcagtcatccacgtgcccttcatcatcatcagcagtagcaagaagaccgtcatcaactgcagcatctccgacgacaaatcagaatatctgtttaagtttaacagctcctttgaaatccacgatgacacagaagtgctgatgtggatgggcatgacttttgggctagagtccgggagctgctctgccgaagaccttaaaatggccagaaatttggtcccaaaggctctggagccgtacgtgacagaaatggctcagggaacttttggaggtgtgttcacgacggcaggttccaggtctaatggcacgtggctttctgccagtgacctgaccaacattgcgattgggatgctggccacaagctccggtggatctcagtacagtggctccagggtggagaccccagcagtcgaggaggaagaggaggaggacaacaacgatgacgacctcagtgagaatgacgaggatgactgacgtcctctcgccttaagattcagcttcaggaaaacatttagggaaaagaaactttttttttttttttaatgtgaggttttctgtttcttttttgcctactcccaagaagatattggtaagctatagaatttagatatgcacctctgataagcaaggattgtttcccgtatgattaagacgtgctgttgatgtgtgttttgataccagtgtgctgacacagaatctttatttactttttaggattttgtgttttcattttctatttttctttaaatgcagagttcattgttgccccttaacagtttttcctgagtttactgaagaaattgtacttcatccacatccatgaaaataaaatgctctccttttgtgc

SEQ ID NO: 542 - DNA, 2055 bp, Homo sapiens
agcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacaggctctcttgtattctttcacctcttcccacaagaaattcatgattgcccaatggaactcgctcagaagagggaactaagcatttttggcaaccaatggcagatatctatggcagcacacaaaaaaaaaaaaaaaaa

SEQ ID NO: 543 - DNA, 4239 bp, Homo sapiens
ctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccggtgagaggcgacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcccggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctggtggtggctgtgtacgccaacctggccagcatttaccggaagcagaagaaccgggagaagtgtgcacaggtggtgcccaaagccatggccctgctcctggggacgcccgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccaaacttcccactacctcaggcaagcgctggcctccctgaccccgggcacaggccaggcgctgcgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccccggcctgcaaggtggccgacaaggtgctggaggggcagctcctggagaccatcagccagctctacctgtccctgggcaccgagcgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcaccctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctggtgtcgccggtggctcattttctggcaaatggaggcacgaacgcaggggccaaatagcaataaatgggttttgttttttttttgcaataaaaaaaaaaaaaaa

SEQ ID NO: 544 - DNA, 2207 bp, Homo sapiens
atatttcttctatgaatcttttgtgtacagatttttgtgtagacatatatgtttttatctctgttgggtgtatacctgagagtagaattactgggttatatggtaactctatgtttagccttttgaggaactgctagactgtttcccaaaggagctgtatcattttacataaccaccagatatgtttgagggttctgatttctccacagtctcatgaatacttattattgtctgccatttttattttagccagtcaagggggtttgaaatggtacctcattatggtttcagtttgtgtttttctaatgagtaatgatgttgagtatcattttatattttctgtgcttattaaccatttgtatatcatctttggagaaatgtctgttcatatcctttgctcattttttaaagattggattatttgatttctcattattgaattgtaagagttctttatatagtctagctataagtcatatatatatatgatttgcacaaattttcttccattctataggttgttctcactttcatgatggtgagaaccttgttttttaaacagtttctcacttgtcttgtgaaagggtactggataccaaccccctcatgctggcttagccatcaaaagcgtcccatttttacactttgtagattcctcttggacccacttttctccaaagaaccctattccccccaagttatccttccagttctctagcatcaaaacaaaattcgctttcatttggcagttgttagtccaaactgcaccattttgtaagtcccccagcattttgcagaccttggtcaaagtgacacattccaggcgagtttgggctgtgagaaacatcctgcctaaccacctgaccacaacacacaagaacatccttatcataccctgctaagcaaaggcccaactgaaggaacgtccctatcataccctgcaactggaacaaagggccaaaccacctgatcataggaacatcttaatatcctgccgggcagcaaaccagacagcccagacccctcctgcccatacctataagtccccagcctgtgaacggcagtgggctctggcattaagctgcaccccccacctctgcaggtttttgcaatatacttgtgttgctgtagagccccccccccacccccatctttctttaactcccaccttccctttaaaaaaaacctaacagcaatagcatggtatgattcaaaaactcattttgccactaactgacattgtatcttggttaggtcacttaatatcactggttctcaggtttttttgtaaaataaattaatttatttctagtaattcatgtgagtagcagacttcattcacctgatacttgattttaaaagaaaagtttttcaacccagggaatttatagtgggtgtcagtcgagaaaaatgatgggacaagtctcaatcattttaggagatttatttgccaaagttaaggacgtgcccgggaggcaagtctatgtctttcttcgaagatgattttgaggtctccaaatttaaaggggaaagggcaggatgttgagaagtacacaattgtcatgtaagaggtgggtaggggcaaatagttatttatgcctttggctcagtgaatctgcattttttacgtaagatgacataaaaggggcagaggaaaatattaggggaatctgcattttacataagataacagacaaaatggggtaggggaacaatcagatttgcatttatgtctggtgggccaggggtaactgcacctgtaagctgtcaattgacattgccatgatgaaattttagctcactgggaatttccctgtgggcaaaatacaggggaggtgtgtagcttttcatcttgtagccatcctatttagaaaccaaaaggggggagacaggtttgcatgacccagttcccagcttgacttcttccctttggctaaatgagtttggggtcccaaaatttaatttcctttcacatttcccttcttttttctgtaaaatcttttggagaaagcattttaaaaggaagacgagttcctggcctcaggttggtttttcctcccttttttgagctgctttcttattgctaggatggtttattcctagaagttcaggtccccagtctctaggaaggctcatttctaagaggtcatgtcccatgaaggttaaaaaaaaaaaataggaagaggaaagaagtaaaaaaggaaagg

SEQ ID NO: 545 - DNA, 467 bp, Homo sapiens
cggccgcagagtcccaccgccaccaggcgacccccacccagagagggacagacatgcggggagccagcaccgggcaagatggctctggggatcctcattctgtgaagacaccaactcatttctcaaacacaggatccaggagacagatggctcctaaatggagatggcacatgctccgtggggtccctcatagaggagtgccaccctccacactggccacgctgggctgccccagagcggccagaaaggaaggtgggagctagccccatcctcactcagaggccggaaggaggaagatggcatctcgccaacttcagagccgaatggcctctagccacactgcttccagaccccagacggggcagcagcagcagttcccagatgagcacccattgttgcagctaggacccaccaaggatgggactcctggagtcaggtgcacaccaggtaacccaggaccacgcctc

SEQ ID NO: 546 - DNA, 459 bp, Homo sapiens
gtcatgaactatttttaacatttccgaaagcctcctggaaattattatgcagccagccacaacagggctgcaacaaaatgccagtatcttcgcttttctctggagtcccatcagctcagtgccgtcacactgatcaaaggcactgcctggcagtcatctatgttagtgatgagtaaagtagacaggaaattcattgttgcttgataaatgtcctctccaagtcaccccatcttgggaaacacaccacctatttacccagttgcccaagtcaaatgcaggagtcacccctggttcttctctttctgtcactctgtctccccaaccccaatccagctcatcagcaagtcccccaagcctggcatggcacaggggctccacaattatttgttgactgaatgacctccatctgataagtgaacttgaatgtgcccagaaaataagaaaataacgaaaagcctg

SEQ ID NO: 547 - DNA, 428 bp, Homo sapiens
atgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaaaaaaaaaaaa

SEQ ID NO: 548 - DNA, 1131 bp, Homo sapiens
  misc_feature (33)..(33): n is a, c, g, t or u
  misc_feature (624)..(624): n is a, c, g, t or u
  misc_feature (848)..(848): n is a, c, g, t or u
ttccgaatatcgtcgaccacgcgtccgtagaanataaaactgctatgagatagaaatgatgtaaaattatgtggaaagttttccctcatatactcacatacagcctttgaagggctctggctctgaccggttgatggccttgagcgagatgaaatcatgaaattgagtcaaatcaatttgacattgaaatgacaagaggaaactcttaaatacataaaaacaagctctcatttgcctaggatagatactgtcttaaaaataaagactgaacctagatgttctgagcactagcaacaaggtattttaacaagtttaaaggaattctctgaaaaagttataaaattattctaggaaacataaccataatagtgttttaagggactttcacctggggattttatattcatgaacagagtgtattctgtatttaaaatgtctcatttgtgggaattggatgacatgttttttgataaatttattcacaatataaattgactttttattctaggaccatgtgaataatgggttccattgcacaaatacaaatattttaatagcttcttaggcagtggtgtagacatcttggatataaataattgtagatcttgtatatttgatttttanaaaactagaataaacagagaggcataaacatatcttagagtccaagtggtagtgtttagcattggatataataaatggatgttttacaaagtgtttccataattctcttcctatacataaatgtcttgttttcaaaagtggatggaacttggctgggtgtggtggctcacgcctgtaatcctagcactttgggaagccaggccgggaggatcacttgagctcangagtttgagacatcctgggccacatagtgagacctggtctcctgaaaaaaaaaagtggatgggacttgtaccagagattttatctacttctccaactgcttcagaatacccattgagatgttccccctggaaagatgaccccatactgcctcttgagccatttcttcccacctaacattcttaaatgataaaggcccaacttttggcattcttcccaatttcgggaacctgagtttgagggggttccaaatttggggaaaaaaatggggtttaaggtttaact

SEQ ID NO: 549 - DNA, 3854 bp, Homo sapiens
gccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaacgaaaaacccagaagagaggcataacaaataccttagaagagtcatcaagcctgaaaagaaagaggctttcagattctaaacgaaagaatacatgcggtggatttttgggggagacctgcctctcagaatcatctgatggatcttcaagtgaacatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtggcacggtcaaaa

SEQ ID NO: 550 - DNA, 344 bp, Homo sapiens
cctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 551 - DNA, 2692 bp, Homo sapiens
acatggatgggtgcaaaaaagagctgccccgcttgcaagagccggaggaggacgaggattgttacatccttaatgttcagtcaagcagtgatgacaccagtgggtcttctgtggccagaagagctccgaagagacaggcgagttgcatccttaatgtccagtcaaggagtggtgacaccagtgggtcttctgtggccagaagagctccgaagagacaggcgagctccgtggtagtgattgactctgattctgatgaggaatgtcacacccatgaagagaagaaagctaagttattggaaataaacagcgacgatgagagtccggagtgttgtcatgtgaagcctgccatccaggaacctccaatagttattagtgatgatgacaatgacgatgacaacggtaatgatttggaagttcccgacgacaacagtgatgattcagaagctcccgacgacaacagtgatgattcggaagctcctgacgacaacagtgatgattcggaagctcccgacgacaacagtgatgattcggaagctcccgacgacaatagtgatgattcggatgttcccgacgacaacagtgatgattcatccgacgacaacagtgatgattcatccgacgacaacagtgatgattcggatgttcccgacgacaagagtgatgattcggatgttcccgacgacagcagtgatgattcggatgttcccgacgacagcagtgatgattcggaagctcccgacgacagcagtgatgattcggaagctcccgacgacagcagtgatgattcggaagctcccgacgacagcagtgatgattcggaagctcccgacgacagcagtgatgattcggaagcttccgacgacagcagtgatgattcggaagcttccgacgacagcagtgatgattcggaagctcccgacgacaagagtgatgattcggatgttcccgaagacaagagtgatgattcggatgttcccgatgacaatagtgatgatttggaagttcctgtgccagcagaagatttgtgtaatgaaggccaaattgcttcagatgaagaagagctggttgaggctgctgctgctgtctcccagcatgattcatctgatgatgctggtgagcaggatcttggtgagaatctcagcaaaccaccaagtgatcctgaggctaaccctgaagtttcagagagaaagctgccaactgaggaagagcctgcacctgtggtggaacaatcagggaaaaggaagtcaaaaaccaaaactattgtggagccaccgaggaaaaggcagacaaagaccaaaaatatagtggagccaccaaggaaaaggcagacaaagaccaaaaatatagtggagccactgaggaagaggaaggcgaaaaccaaaaatgtatctgtgacacctggacataagaagcgtgggccttcaaagaagaaacccggtgcagcaaaagttgaaaaacgcaagactaggactcctaaatgcaaagtccctggatgtttcttgcaagaccttgaaaagtcaaagaaatactctggaaaaaatttaaagcgaaataaggatgaattggttcagagaatctacgacctgtttaacagatccgtctgtgataaaaagctgccagagaaactacgcataggctggaataacaagatggtgaaaactgctggcttatgcagcactggtgagatgtggtacccaaagtggcggcgctttgccaagatccagattggcttgaaagtctgcgactctgcagaccgaatccgggataccttgatccatgaaatgtgccatgctgcctcctggctgattgatggtatccatgattctcatggtgacgcatggaagtattatgccaggaaatccaacaggatacacccggagctgcccagggtcacccgttgccataactataagattaactacaaggtccattatgaatgtactggatgcaaaacgaggattggctgctacaccaaatcgttggacaccagccgcttcatctgtgccaaatgcaaggggtctctggtcatggtgccattaactcagaaagatgggacccgtattgtgccccacgtgtgaccatttgctgtgtatgtgcagaagtattatagaaaaattatgcaggagatggctaggattagccttggggatgtgatgaaaacacttggcaggaattacaaggcaatgaagaattcttaaggttatcttagagtatattaatgtgagctatatcctttactggtaagaagttttagaaaagtttgttttgtgaagttaggaatattagaatttaggtactgttaagtaagtaatgttagaatttaagattcatgttattaacgatgattgaccttaaatagggactctattgctaaccattctgtgcccttgacagggtatttctgaagcccttgggatctaccttgggtcttacttgagttccatatttttcacatgtagaacaaaatgcaaaagaaaagtgagttttcaagagtggcaggttgagagaggagaatgctggaaagaggacaagtttgagaggcaacacttaaacactagggctactgtggcatctatgtagacaggaaagacaaacgtgtttcataaaattcgttgttgatggtattgattgaaactatctgagccatgtaatcaaaaaataaaagttttctgcatcaaaaaaaaaaaaaaaa

SEQ ID NO: 552 - DNA, 390 bp, Homo sapiens
ttttttttttttttttttttttttttttttttccttttacaaaatataaatttattatgaaaacctggaaggataatccaaggaaggtaaaaaaagaaaaaaggaggccaccaaaaaaaggcaggaaggagaggaaaagaaaaaaagacaaagaggagatgagagaaaaaaatccagttcagcacaacaaaagtgcaaaagctcacctacccaaatggcattaaagcctcgttgtgtaatcgtgtcagaaaacaaagcatactgacacatagggctttacttcccatccacttgagttttaagaggtaaattaaaaagctccttgggaaggggacatgaggttgttcaaaaacccaacaaagaaaattaaaaaaaaaagagagagagaaa

SEQ ID NO: 553 - DNA, 4314 bp, Homo sapiens
gaacagattcatgggtgatttagcctatctgtcccaggccagcgtggctgagtgtgctggctggaggcctctctctctgcttcgagggtagctgagatccaccccggaaaccggcaggatgaagggggcaagtgaggagaagctggcatctgtgtccaacctggtcactgtgtttgagaatagcaggtatgggcagctggggtgggagggtcaccatggtgggctggcagccaccctccagcctttctggcagctctctccctgggccctgccccggaccctcctcctgcaggggcagccccgcgttcctcggtcacggattccttggagcatgggagagtgtcggtgggacaccaggagccaggcaggggtgagagtgccagtgtgtgttgggagagtccagacaggtgtggttacgagcaagcatgggcagaccaaagcctgtgtgtgggcacaggaccccacccagtgcctgccagcacctctcagaaaaggtagctgatactcaccaagaatttacgccctatgattaggataaccatataatttatcattcagcacacaattgaaactgaaagtaaatgccaaataaaatgtggtggttgtgggggaggcattacaggtaaagctgggaccgtatgaggcaaaccaggatgtacgggcagcatcctgatggggtactccctactctaagttcatgtccttacttatttaatttagtcatcgaacagcctaacaggggtagattctgtttctgttcccgtcttatagatgaggaaatggagacacagagaggtgaggatgccaagtgctttaagtatctggggcaatgctggggcgtctgtctggagggaaaaggctgggccagatgcgtggagtcattggtagccctgggagcatgtgtgtttgtgtgtgtgcgcgtgtgtgtatgtgtgtgttgtgtgttatgtgtggcatcaatccattctgcaggcatttcttaagctcaggactgtgttaggggctgtcccaggtagggttttctggaaatagactcagacagaggtttgcctcaggtgatttatcagggagagcttttgggaacaacagctgtgggtgtgagggaagcagggccgggcagggggagatgctgaactgcagtgcacctgccacagaggcctcagcctgtcccagggagctctggagctgggatgcctctcggttgttccagctgaggaagagggctgggtatttgtatctccatgtggactggacaagagactctgggtgaggcagctctctcttccagagagtgattcccagagagggactcagccaataaattacccggcagcccccagtactaccagtagctggtggggatggtgtggggaggcctcattcctgaaggagggacatgggtggcacagcacagcatcctacaggaactgtagaggatgaagaagggtttcagtatttggatgctgagctcatcgaataactatgatgcaaggtcatagacagtagatgtcctaggaatggcccggatgctgtattgagggcactcatggcaggcaatgtttcctgtaggcttcagggtggagatggcatagatgtagacctagaagtcttcaacttcctgagctgggtgattctcccctgcctctcccgggatctttgccaagctcgtcctgttcagcaccaaagacagctcttgggtgccgccttcctggcccaccacccccttgggtgtgggtggatggtaccacctcactcaacatgcttgacgtggactaggcacacctgggtggagcccctcagcatgctgtgctctgcccaggcaataaccctggcaggagtgggcagcccttagacgggagttaggtcccagcaggcatcaagagggtgagagccactccttactgagtgaggggacccataccaactgccttggcctgggcttccttatgaggtctccagcacctcagctgatctgaaactgaggggcaaagaggaaacagaagctggccaggggccctagaacagaaatgcagaacctgaaaccaaatgtagaacagaaagcctgagaaccagctacgcccatgagctgcagacccatgggctgagaaaccagggactggggtgccagggaggggtgggagagcctgggagtagccacacagcactaggtcccaatgctttcgctgccacaaacccaattgtgtcacttggggcaagtcactttgactccgcggacctgtttctcctttactcaaatggggaggggcaggttagagtgaaggctcaggaagcagtcgcctgatttgaatcccacctctgccacttccgagccgcatgttactcatcctgtccagacctcagtttccttgagtgcaaaatatgggtaatgaaaacctttctcacggagttttggagatttcgtatttgtttggccttccatttcctggcctgtctttctcataaggatgcctgccctgttctgtcatcacaagcccttccacaccaagggcaacgttgggtgtattcatcaagggtgggccctgttgtctaaggaatttgactggcttgcagaacccagtacacagggtaataaaggtgacctacgaaggcccgtccctgggagaacagagcatctgctgctgggctggctctccctgcttctggacgtgtggaggatgtcgatcccattgagaagccccagcttttgcaggcctgctctcactttatattgttctgtggctcctaccttcccttgatgtataggttactgatgtggaaactgaaaacagaggtgaggtccaaaggtgaggataatccagggggtaccactcaaaaacccctatatacagaaaggattcctggacactgtggcttcattttaaacaaggaagtatgcagttccccagaaaataaaatatagtccaccctgactcattttgaacactgagttccctccaagaatgtgttgggagagaagtgaaagtcttactcagcatgttcccaaagaaagccaggcacccaggggcccctgcactggggatttgcaccaggcaacccaaatccacaccagggacttgctgctgttttccctgttctccagggaggaagccctcaggtctgtctcttctcctcaggaccccagaagcagcacccagaggccagaggctagaggacgtgcatcaccgccctgagtgcaggcctcccgagtccccaggaccacgggagaagacgaatgtcggggaggccgtggggtctgagcccaggacagtcagcaggaggtacctgaactccctgaagaacaagctgtccagcgaagcctggaggaaatcttgccagcctgtgaccctctcaggatcggggacgcaggtgcctgagggctgaggtagaggtgtggggtgctggggtggggagctctccctgacctcacctccacacatgctttcctagccagagccagcagttccccaggtgggggtatggtgtgatcagaggtcagctgggagctagatttccccatgcttaatggcctttgattcactaactgcctgctacgcaccgtgctggattacttcgcgagtccctcgtgtaggagttttttggacaaggaagttgaaacacagttttaaggaacttattcaaggccacacagcttggaacagtctccatcttgtgaacctaatactcttctcaggtggggcctcagtttacccactggaggagacaacaatctcaacctagaaatagaggtctgagtgtgaactgtcctgcccttagactaaagcccagtctgatctcttctgtggcttgcagttttctcatctgcagagttcaagggttggcatgcagatactgtgcacccaaattccctggagtcacatcccagcacgtctgcttactaactgtgtgtccttgggcaagtcacttgagtctctttgtgccagtttcctcatttgtaaaatggggatagtggttatagtaatgcgtcctggttttcaatcgctgctgaacaaacctatcaaaaatgtagcggctggccgggtgcagtaactcacgcctgtaatcccagcactttgggaggccgaggtgggcagatcacctgaggtcaggagttcaagaccagcctggccaacatagggaaacactgtctcaactaaaaatacaaaaattagttgggcatggtggtgggcgcctgtaatcccagctactcagtaggctgagacaggagaatcacttgaatccaggaggaggaggttgcagtgagccgagattgcgccactccactctagcctgggtgacagagcgagactctgtctc

SEQ ID NO: 554 - DNA, 689 bp, Homo sapiens
aacgtctcaactgtaaactctgggcacgcggctagcgccaggtcctctccagccctaacattctgtgattctaaacttgtctgatttgtctcatatgttgcaaggctcgtagcaaaaagaaaaaaatactccataactatttaacaggaattagctaaagcacagctctagagagagagacacacacacacgtttcaaataacccgaacactagaacctagtgaattttatacctttactaaactttagcgattatttgtttctttcgtaacaaaggttattgattagatttagtgctgaaaaaaaccaacaacgtgcgcttcggtcatttgtcttatggaggaaacataaatctataaatcttcctcctgtctctaagaaataaaactctcttcatttccaaagtaaaaaaaaaaaaattggcaaaataccaaaaaggtcaaaaaaaaaactcgagggggggcccggtacccaattcgccctatagggagtcgtattacaattcactggccgtcgttttacaacgtcgtgactgggaaaaccctggcgttacccaacttaatcgccttggagcacattcccctttcggcagctggcgtaatagcgaaaaggcccgcaccgatcgccctttccaacagttgggcaccctgaatggcaaatggcaaatttggagcgctaataatttgtta

SEQ ID NO: 555 - DNA, 4828 bp, Homo sapiens
cactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcggaagaagcctgccagctgcgtgcttatctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccgacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttgacaggccctgtgaattgtgcaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcatactgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcaggaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggaggcggatgaccctgcccacttattcctggatggattggaagcagccaaagacgcaagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtatagctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcactgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggctttggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaacttttttacgcacaacttttggtgcgtttttctagttttaataccttaagctttttcaagacctaactgcagccgctttgggaaaaaaaaacaaaaaacaaaaaacag

SEQ ID NO: 556 - DNA, 279 bp, Homo sapiens
gggggcgccgtccatggagaagccggatgtggcgaatacacaccctggggcacattgatcagtgctacgcatgagatggggggcagcgtgggggccgtatacaacggcgagacactttaaccaggtgtagatcaagaccgagatgatcggccactacctgggcgagatctccatcacctactagcccggaaagcatggccggcccgtgatcacggccacccacttgtccagcttcatccctctgaagtaatggctcagctaataaaggctcacatgact

SEQ ID NO: 557 - DNA, 390 bp, Homo sapiens
tttttttttttttttttgctctgctggcaattccaagaacatcactgctacattgagcaactatccatctttaaagagccagcagagcaaaacaaaataaatctcttttccaaagccaggataaccaagaagacttccttcaaaaagcaggggactgggaaaaggggaaaagggaaggaaagagataaagtaaagcttttccaaattttggctttttgctcctattccctctgcctgttttgaaaacttaaggataagcaatgacattagcagtgtctttggtatctaaaccaaatcccacttaagttctgtgggatcatttatttaaaaaaatagcctttctagagatacagtctatatccaaactcagggagccaagaaagtttgtcc

SEQ ID NO: 558 - DNA, 1227 bp, Homo sapiens
cgtagcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttatttttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcaaaaaaaaaaaaaaaaaaaa

SEQ ID NO: 559 - DNA, 452 bp, Homo sapiens
  misc_feature (1)..(1): n is a, c, g, t or u
  misc_feature (340)..(340): n is a, c, g, t or u
ngacaaatagactcgcctaagagggcctttctctccaagccctcgccagcacaggctgtgtcactttcttaggtggcacctaccgtctgttgcacacttgctgcagatgatttggcacaggatgtcgcttcagaaaaccttgtaggaagccgtgagtcgttaccgtccccatttcacagacaggaaagtgcaggccttagatgcactgcctgataccctgtggcccccgcgttcctagacagatacactgcctggtacactgtacccccccacccccgctatcgtttgcaagctggggttgaacccctgcaattcaatagacaaggttcccccttgagtnagccccccatctgcttaactgagggcttgtcctcggttataaatgtctgggtgggggtgggcactgctggctgcagctgtcaggactgggaatgctgaacctgcactgaggg

SEQ ID NO: 560 - DNA, 1197 bp, Homo sapiens
gtagcgggaaccatatacggctaggtacgaggctgggtggctaggcgcatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccgggacggcagcagtgcggagctctggactggggattaagaaggggcccccatgcaaactcaaattccctgagcctcaagaggtggtggaagagttgaacgcaagtacctgtcgatagggagcattgggtagaagccctcattgctgagctttgtgttccctggtgatgtgggaccattaatgatggaacatggccaaatttcagtcattgatcctgaagccatggtttcttcccgtgccagaaatgacaggctcagttatgaggcaaccctcttagtagggcattgtaaaacgtacctggattggggtttactaccaccgtttgacacttacggtacacacaaacacacaaaaaaaaacgttggggggcactctatagtgccgaggggcgcggacaacaccgcggttacatgaacgtggcacattggggccaatagggtgttcccctggacgcacagtttctttggtacacagggtggggtaaactctggcggggacaccccttaatagggagagggcgagaataaattttcggataaacgcagggttaccttgtatagacatcttgactgtacaacaagaggggaacgaaaacgaaagcacaaaacaaaggagaaaaacgacgactgggagaaaaggaggaggagagggaggaggagagggagagcagaagaagcgagaggagcaggaaaagaggaggaccacccaaagagacgaggaaacaagagaggagagagaacagaggataacgcgaaagaaaggaagaagcacgatgcaaacagaaacaagacgagacagagtgagcgagcaggagagaggggagaaaagaaggagaggagaggagagaggagaagaaagcaagaggaaggggacgcagacagaagggcaggacg

SEQ ID NO: 561 - DNA, 764 bp, Homo sapiens
ggcacgagcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctccccccaatgcaggccacttctcctccctccttctctaaatgtagtcccctctcctccatgtaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttcaaaaaaaaaaaaaaaaaa

SEQ ID NO: 562 - DNA, 2661 bp, Homo sapiens
gctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttacgatgacaagatctactacttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtgcgcacggatggtgaggggctgagaatgagggcaccgactgtgaagctggggcatcgatgacccaagactttatcttctggaaaatatttttcagactccctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcc

SEQ ID NO: 563 - DNA, 507 bp, Homo sapiens
ttctccaggctggccctcagcctggcgccccttccgcagacatccctagaaaaagaactaacgcggccttctccgagcccagggctggagtaggaagtacccgccctcccgaacgcgaggtcctggctgcgcattggctgcgaaggccgtcagtactccggagggcggagcctcccggcacccagcggaatttcaggcccgcacctccgggagggtcctccgggctcccgggcttctttcctcccccttaacactacccccgcacacacaccggccccgagaaggcaactagcctcctcaaacggttcctttgcctttttatttcgcaggccttcctctcaccccatacagttactgcccctttgactcctccgagaggcaaagctttttcaaagctctaacacctctcccctaccccagcaagttccccgtgcgagaccaaatagaggatgccgctgttctaagagtgaagcaagctgtggactggatctcgccgagggagagaga

SEQ ID NO: 564 - DNA, 430 bp, Homo sapiens
gctttaaaagttatcttttattaatatattgtgtgtgcaccttgtcttcctcaggcttagaattccccaggtgctgggaacttgagcctgcttccctttcctctgtcttccataattcattccttaatgcaacatctcctgagggcctactttgtgtcagaaactacattatttgctaggggtgcagagcccaggaaggcacaggtgcttccctcaagcagttctgaaatgaatagggtacagataagtaaacccccctctcctatccagtgagtagagttgtgtacaaggggacacaaaatgagctctggagacttgctcccccaaaatgggagccatggaccatcagcattggcatcacctgggagatcaatagagatgcagacccctgtacccattcagttggagtgtgcatttgaaataagatccc

SEQ ID NO: 565 - DNA, 642 bp, Homo sapiens
gctgaagtgaaaacgagaccaaggtctagctctactgttggtacttatgagatccagtcctggcaacatggagaggattgtcatctgtctgatggtcatcttcttggggacactggtccacaaatcaagctcccaaggtcaagatcgccacatgattagaatgcgtcaacttatagatattgttgatcagctgaaaaattatgtgaatgacttggtccctgaatttctgccagctccagaagatgtagagacaaactgtgagtggtcagctttttcctgttttcagaaggcccaactaaagtcagcaaatacaggaaacaatgaaaggataatcaatgtatcaattaaaaagctgaagaggaaaccaccttccacaaatgcagggagaagacagaaacacagactaacatgcccttcatgtgattcttatgagaaaaaaccacccaaagaattcctagaaagattcaaatcacttctccaaaagatgattcatcagcatctgtcctctagaacacacggaagtgaagattcctgaggatctaacttgcagttggacactatgttacatactctaatatagtagtgaaagtcatttctttgtattccaagtggaggagccctattaaattatataaagaaata

SEQ ID NO: 566 - DNA, 4894 bp, Homo sapiens
cgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagaccaaaatgttacagacagatgctgaactacagatgcaggtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttgtgaatgtgttgcactctgctggatgaaatggcagtggatttttaaactttaatttcccaaatgtctctctcagccctgatgttttctcacagtgcttccttgtccttctcttaacttctcattcctctataagaatgatttagactgacctgtccttttttatctgcgcatgcgagaacatcaccttcctctgtacacttggaaatgcctctggcttgttgcagccctcctttaacccaaaggaggaaaggactgcttcagaaactcccaattccaaaaagctgagtctgggtccattattttggcagaactcctaagaatttatgggagcctatataaacatatcttgcttttaaaaagttcttgagggaatagcaactttcccatggctgtgcctatttcctagaccttttaaaagatgtgcagagcagcttagcattcgttgcagctgagcctaattttttcttgctcatccttgtccctttgacaataaggttaattgatagacccaccacctcttgcactctcgcttttggagcaagttgcattaactattttgagtctctatattgtccaagaaaagtagaaataataaatttactttccctttttctatcaccttatgtcctctaccattttctccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaactt

SEQ ID NO: 567 - DNA, 315 bp, Homo sapiens; identical to SEQ ID NO: 522

SEQ ID NO: 568 - DNA, 2321 bp, Homo sapiens
cttcctgaaaggatctggagacaccagctccacaagtcctggtgtctttaaaaggatcagcttgaggaataaggctcgtctgagagctgtgacattcatctgactctagtgaaagtccaacagccactccctttttggcctccaactgggcaccatgagggcctgcatctccctggtattggccgtgctgtgtggcctggcctgggctgaggaccacaaagagtcagagccattgccacagctggaggaagagacagaagaggccctcgccagcaacttgtactcggcacccacctcctgccagggccgctgctacgaagcctttgacaagcaccaccaatgtcactgcaatgcccgctgccaagagtttgggaactgctgcaaggattttgagagcctgtgtagtgaccacgaggtctcccacagcagtgatgccataacaaaagaggagattcagagcatctctgagaagatctacagggcagacaccaacaaagcccagaaggaagacatcgttctcaatagccaaaactgcatctccccgtcagagaccagaaaccaagtggatcgctgcccaaagccactcttcacttatgtcaatgagaagctgttctccaagcccacctatgcagccttcatcaacctcctcaacaactaccagcgggcaacaggccatggggagcacttcagtgcccaggagctggccgagcaggacgccttcctcagagagatcatgaagacagcagtcatgaaggagctctacagcttcctccatcaccagaatcgctatggctcagagcaagagtttgtcgatgacttgaagaacatgtggtttgggctctattcaagaggcaatgaagagggggactcgagtggctttgaacatgtcttctcaggtgaggtaaaaaaaggcaaggttactggcttccataactggatccgcttctacctggaggagaaggagggtctggttgactattacagtcacatctacgatgggccttgggattcttaccccgatgtgctggcaatgcagttcaactgggacggctactataaggaagtgggctctgctttcatcggcagcagccctgagtttgagtttgcactctactccctgtgcttcatcgccaggccaggcaaagtgtgccagttaagcctgggaggatatcccttagctgtccggacatatacctgggacaagtccacctatgggaatggcaagaagtacatcgccacagcctacatagtgtcttccacctaatagaacttcgagccagaaaggggcatgagggctcttgcgagactgaagtgctatcttctctggactagagagaagagggagaggactggaagggatcaccaaatctcaaagcaatgagaagcattcctaaatcccaaagtgcccacatgggaaagagataaaatgtacaaattagaaaaatgtggataaacagtcaaacctttatcctctagaattttggcaatgttgactaagaaacagagtccaagcagagaaggtaggaaccctccatagctctctgccctgatgtgtgggggaactaggaagaagtcctttgacctcaccaggcctcatgcttccctttaatgtaaagggaaggggtttgcccactttcctctttttggggttggtgagagggcaaaccctgatatttttactgtgaaggtgttttcagttgttcttaggaagaacagctgatagaaattcaagattactataatggctgttattatacacagctctgtaaactaccactcagccctgtgttggggtcctcaaagaagtaaggccacagtaatcaagcaagggcctttggttttttccagagttagatcctctcagaacagagtctgggagaactccaatgctgaatggagaagggtaataggttggtgcagtgaatgggctgggggtggggtggccttctccaggcctgagtgtttttgtgtccagctcagtatctgcaacaagaagtttcccacttgtggatgtttagtgcagccacagacttgtattttgatccccaatttttttttgaaagagttctcctcataggaggatgattcagcatcagaagaagaaggaacccatagcttggtgtcattaacataattattttaagccttatccagcagccataatttgaataactctacgagaccagagagactgtagttccctattttaacctcaattatgcatttgtcccccaaccccactgagaactaaatgctgtaccacagagccgggtgtgaactatggtttagaaggttcaagtttccaattaaagtcattgaag

SEQ ID NO: 569 - DNA, 497 bp, Homo sapiens
tttttttttttttttttgaggggaggaagtggaggagagatgataggaaactcctccttaaggttgccgactcctaactttctgaaaatgactaaggaagagaaattccaagggaagagaaacatgtttctttcttggtctctggttatcccacctgaggagagaggcctctgatgaccagacatggacaacagggaggtgctggtttctggaaatgtgtaaccaagttggagcaccagcagggatggattacacccacgggccacctctcatttcagatgattcgcattgattctcaactcattagggaaacccgccttgcatctccaagggcttcgaaatttgatacaggaaataagatgtggaggtaggggtgatgtttcatcccttcttctagttgtaggccataactttagaaaagaaaagcatgtatggaaatttaacaggataccatttagatgcccgcaatgagcaggatttgttttgctaaattatgg

SEQ ID NO: 570 - DNA, 658 bp, Homo sapiens
ggagcctcacgrgagcgkggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgccaggcctaggctctctgtagagagtcttcaagatcccggagtggtagcgctgtctcctggtgaaggagtatttgtcacactggaatgtgactgtgtgtgtatgtatgtgtatatatatatatatatatatatataaacaagtttgttgacacctacaaaaaaaaaa

SEQ ID NO: 571 - DNA, 4045 bp, Homo sapiens
atctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgccttccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaagggaaggaatattagaaaatcacacaaggcctcacatacatgttatttaaagaatgaattgggacggatgtcttagacttcactttcctaggctttttagccaaaacctaaagggtggtatccatattttgcgtgaattatgggtgtaagaccttgcccacttaggttttctatctctgtccttgatcttcttgccaaaatgtgagtatacagaaattttctgtatatttcaacttaagacatttttagcatctgtatagttgtattcaatttgagaccttttctatgggaagctcagtaatttttattaaaagattgccattgctattcatgtaaaacatggaaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacaaaaaaaaaaa

SEQ ID NO: 572 - DNA, 1575 bp, Homo sapiens
gagagaggaagcttgaagccaatatggagtccgtcagttgctccgctgctgctgtcaggaccggagacatggagtcccagcgggacctgagcctggtgcctgagcggcttcagagacgcgaacaagaacggcagctggaagttgaaaggcggaaacaaaagcggcagaaccaggaggtagagaaggagaacagccactttttcgtcgccacctttgctcgggagcgagcggccgtggaagagcttctggagcgcgcggagtcggtcgagcggctggaggaggcggcctctcggctccaggggctgcagaaactaatcaacgactcagtttttttcctagccgcttacgacctgcggcagggacaagaggcgctggcgcggctgcaggcggccttggccgagcggcgccgggggctgcagcccaagaagcgtttcgctttcaagacccggggaaaggatgctgcttcgtctaccaaagtagacgcggctcctggcatccccccggcagttgaaagcatacaggactccccgctgcccaagaaggcggaaggagacctcggccccagctgggtctgcggtttctccaacctggagtcccaagtcttggagaagagagccagcgagttgcaccagcgcgacgttcttttgaccgaactgagcaactgcacggtcagactgtatggaaatcccaacaccctgcggctaaccaaggcccacagctgcaagctgctctgcggtccggtgtctacctctgttttcctggaggactgcagtgactgcgtgctggcagtggcctgccaacagctccgcatacacagtacgaaagacacccgcatcttcctgcaggtgaccagcagggccatcgtggaggactgcagtgggatccagttcgccccttacacctggagctacccggagatcgacaaggacttcgagagctctggtttagataggagcaaaaataactggaacgatgttgacgattttaactggctggcccgggatatggcctccccaaactggagtattcttcctgaagaggagcgaaatatccagtgggactaagcagttgtcactctgttcttcactcctaccaaatactttccacgttggactttcccccttattgggtctcgaagtttacttattgtcacactgtgtatgttttcagcattttaaggctagagattgtaatgggctcctacttgtaatttccattaaattcgtaacaggtataacactaaagcatttttgctattttcgtcatgcctttgagactgagtcttactccgtcccccagcgtggtggcgcgctgggattacaggcgcgcgccaccacgcgaactcgtatttttagtagagacggggtttcgccatgttgtccgggctgctctcgaactcctgacctcaggtgatccacccgcttcagcttcccaaagtgctggcattacaggcgtgagccaccacgccagggctttatttatttatttttaccacaatagtttgaagcagtaagggggaaggagggtgattatattgctttgtaatggtttgtgatacttgaaacatcacggtgc

SEQ ID NO: 573 - DNA, 995 bp, Homo sapiens
tttgggggtgataaaaaggggggcccaaaaaacgggggagcggagatttttttgggaaatttttttttttttcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcttggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggctcgcacccttgggtgctcccggccgccgcgcttaagaacattgcctctgggtgtcatgtggaccagacttctgaatagagaatatttataacttttgtatgagagag

SEQ ID NO: 574 - DNA, 3367 bp, Homo sapiens
ccttctggcactttctatgggaggattctcgtaacagcagcacaccaactgaaaagcccaaactgctcgctcttggtgaaaattatgaactgcttatctatgaatttaatttgaaagatggaagatgtgatgcaaccattttgtatagctgtagtagggaggcattgcaaaagctcattgacgatcaagatatcagtatttccttattgtctttgagaatcctgtcatttcacaataacacatcattactgttcatcaacaaatgtgtcatcctacatattatatttcctgaaagagatgctgcaattagagtactcaactgtttcacacttcccttgcctgcacaggcagtggacatgattattgacacgcagctctgcagaggaattctttttgttttgagtagtttaggctggatctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagatttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataaa

SEQ ID NO: 575 - DNA, 1615 bp, Homo sapiens
gggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagatggctgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgattaaaaaaaaaaaaaaaaaaaaa

SEQ ID NO: 576 - DNA, 2882 bp, Homo sapiens
ctgcaggtaacggatcagcgctgccgggatcctttcaatcatcaggaacagcaacaggtttgcagggtcaggctggggaccctcgcccattaactctttcttctccctgtttctttctcttaggtgaggggaaactgagttccagggtaggctccagagtgaagagggaagaaacatgattctcaaggccaggtctggacaagtgtgaacaccttgggcctgcgaattcagccccctccttcctttctctggtcaaaggctagacttgcaggagcttgcgtttgaagggacagcccagaaggcatcgtctgcactccccatacaggtacttctgggtctgtgggactggcgcagggttcttctcccaaagctgccagcactgaggctgaggcagtgtcaggccggcggcagcggcagtggtgcaatcgttctgggaaggatagtggccggcctgaattctctgtggcaagggaggggagcccaagtgggaggccccttggggacaccgaggaccaggtccgctactgctcctcccccaggaggtcccctaggggctacattggctggcaggggctgagcagcggtgagcctggctggcttcgacccggggcgactccgggcatccgggacagcttctcctcgctgccacctcggccagtcagaccccgagacacctgtcactaccccctcagccttcccaagccaggagcctgggagtccggctctggcctacctccggcagcgctcctaggcgcacgtcccgggctggcggcgccggggcccgccccctagggctgcggcgcgcggggcgggggctgggggctgcgcggggcggggcgggcccgggcgctccgggccccctcccccgcccccctgacgtcagcccccggcagcctcgagctgctcacttgcgtctcgccctccggccaagcatggggcttcccaggctggtctgcgccttcttgctcgccgcctgctgctgctgtcctcgcgtcgcgggtgagttcgcttcgctcgcaggggccgcgccccggctaggggtctgcggtggagcgtgccagggagcagagccagcggcgcggcgggtcggggcgttgcgtctgggaggacgagcctcctccctgggtccccgatccccgggcccttgcgcgcgagcaactcttctttgcagccagtttgcagccgggattctagagtatcccgggagcagcactcggaaggcggggaggaggctgcttctgggaacgagaaggggtggagctcagcctttcggggtgctggggggtgggtggtccctgaggtgctcactctgggggcccgcaattgaagccgggcaggaggcgcagctggggcgcatcctcaaagcctgaattccgcgcccggctgttgctggaaaaggcagcttccttcgctggagggggtgcgccgacccaccccttcccccttctgcctgggcatcacgccaggctggaggtgagcgagagcgggaggttcggcggctcccgcccgagctgggcgttggcaggggttgcggggcggtgtgggtcgcctcgcgcctccccgagtgatgggatcataggggacagagatgagggatggaggattcccatactggacgcccgctggcttattttggggaccacattcaggtgggaagtgcgcccgggcacctcggagcgtttctccggatccgcctggtagcagggtgctctcgggtcccgctgcccttgtatggcccgcgcagcggtgtcgcgtgtttctcttggctcccattccgccgtcccgctgtccggctggggaaggggagggctaggcaataccagctcgctggcctcatgcccagtgccaaccatgtcctggggtattccagctactgcctcccaggctgactttatttctgggaaagggctaaatcgggctccacagttgcagccggtccagctccaccctgccctgctcttctagtctcgggaggagtcaggggtctgaggctctgggttggagaccccaccttccacctgccctccttgtccgagagccaaggtaacaacccaggactcccagagtcccaggcagatggtgtcgagtgacatcacctcctcacagggctggcagcacgctggcaccactgacgtcactcctgcccactgcctggcccttgccctgacccctgggggagactctgacctctccatccttaccagctacctagggtggggtccgcgggtgtgtgcggagtgttcatggcggtgcagctgagggagggagcatgagaccggaacttccgccagagttagcccgctggggagtgagggcagggattttggagggcagaggggtagagcagtggtgtcttcctggcggtggtgacacaaaaggcctgttggccccagcctggcacatcgtttgcattcccacactctgagctcacccggagaggagggggcctggaaggaaaggcgttcctcttgccccgagcctagttgcccctttctgcccctctacagcctcagctggagctgtcggtgctcagtctctgctcaatctctgcttggctccaaggacctgggatctcctggtacggggagagggctggcccaggtggggtggcgggtcggggtgggggtagagcgttcagagacagggccctctgcagaccctctgagtggcaggaaaaacagctcgacgagcgctgcgaggggaggggcggacacgacgcggacgtgacacagcctgggccccgcctccctcccccaggtgtgcccggagaggctgagcagcctgcgcctgagctggtggaggtggaagtgggcagcacagcccttctgaagtgcggcctctcccagtcccaaggcaacctcagccatgtcgactggttttct

SEQ ID NO: 577 - DNA, 2733 bp, Homo sapiens
ctcgcgaggccggctaggcccgaatgtcgttagccgtggggaaagatggcggaaaatttaaaaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccggacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaaggggtccctggcctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactaggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccggccccccagactaacctccaggcatggactgaatctggttctcctcttgtacacccctcaaccctatgcagcctggagtgggcatcaataaaatgaactgtcgactgaaaaaaaaaa

SEQ ID NO: 578 - DNA, 710 bp, Homo sapiens
gagaggtggaggcgctttgaaaggtgagagcgcgagggcggtgcggggctgtctcccggctgggactcgctcgcgctcccggtgctaatggtttatgagagggcgggggaagccgtgcctcctcgcggactaagagaaaaattcccgcgggcgctctttgggtgggccggagaacgcccctcagccctttgcgcctctaaccctcctcagctgagctgcagtgggcgcggtgcccgttatttccgccttggggaggtgcttggaactgatgtagggagctcggttggtgatttctcgggtttctggcctttccagacccttgtaattgttttctcggtgcagagctcttttggggtctgggggtttccgtcgtcctgcgcgcgtcatcgcgaagcttggcctgagggtccggtttcctagctactgtgcccctccctcctggaggcagagtgacggactagtgggctagcgggcgctgggttcctgcgtcccgccaaagaggtttgtaatcatgaaagttcacccttccgggtgttaattcctgagaggatctactccactgtctaccactcattcctgctgcattaaccttcattgttaacggattttaatgaataatatagttatcccggataccatgctggcaggatccactttgcgaaattgtggactgttggactgtgattctaagtgggggaaataggctttag

SEQ ID NO: 579 - DNA, 287 bp, Homo sapiens
  misc_feature (235)..(235): n is a, c, g, t or u
caccatctcctgcgtctcgcgggggtaggcacgcacgaagaacatccggctatggcacagccgcatatgcgcgaccttcaccgtcgtcgtcacgccggccagcaccacgacctcatggctccagtcgaactggtaagcctcgcccggctcaaagctcagcggcacgaacgcggtcgccgtgcggcccacttcctcgcgctgccagcggcgggcatggcggcgaacggtatcatanccgccctcgtatccttgcgcccgcagcgtctcgaacaggcggatcagcgtca

SEQ ID NO: 580 - DNA, 2693 bp, Homo sapiens
cgaaaaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatggcgatgctgttgagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgacccaaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagccttcggctggaagtccatgggccaccctgttcttgtccatggaggacttccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtcctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctaaaaaa

SEQ ID NO: 581 - DNA, 4633 bp, Homo sapiens
tacggctgcgagaagacgacagaaggggagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggcgaacaaggagtcgtcagaaactccagaccagtttatgacagctgatgagacaaggaacctgcagaatgtggacatgaagattggggtgtaacacctacaccattatcttggaaggaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgcctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgcgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgcatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 582 - DNA, 770 bp, Homo sapiens
ccaattagtgtcctaactctgtcttcccatagtaccacccaaaaagtgctccatgctcaagtaagtttggttaaatgaagtagattgtcagaaagacagaaagattctcagtcttttaatacactgatatgcattttgaaatatgtagttaattctcaattttattgcagaattctgcaaacagtggttaacattgcttacagattttctgcatgttaatttgaatctttaatcatattaaaatgcaaatactcctgggaaggataatgaacttcttaacttgtaactgaaaacattcacacattttctcatagtgtcgttgtttcaattacttacctgaaaagaactttttgtacggtacagcacttggctgggttaatactcaccaactttgagaaggttggtctctgctcttctgtatactttttatgaggcagtatcacttagggcttaaggtttaaactttctttttctctctgtgttcatttcatattgagattatggataaaaagtttgttctgacattgcttaacatttttctttaatcatgtgattacagaaattcaatgacttacaaaacaataaatgtaccttagaatgaaaaatgcatcagtaaggtctgtatttaaatgtggatgtagacatcataattaccaagacaagaaattgttttgagaaattctctgatgtttttcttcttcaggtttcacgtgccacgatcatggtgccacggtactgcagtatgcacccaaacagcaactcctaatctc

SEQ ID NO: 583 - DNA, 391 bp, Homo sapiens
tttttttttgtacatgactctcattttattgtttcttagacatttagaaacctgggagtaagagcaaaaactcacggcctaattatgtttacactgatagtttaaagatattttagcactaaccagcatcaattcctaatattcattcaaaatgttagcacttggtataaagaaggaaacaggttgagcaaggtggctcatgcctgtaatcccagtactttggcaggctgaggtgggcagatcacttgagcccaggagtttgagaccagactgggcaacatggcaaaaccctgtctctacaaacaatacaaaaattagctgggtttggtggtgtatgcctatagtcccagctacttgggaggctgaggcaggagaatcgcttgaacctggg

SEQ ID NO: 584 - DNA, 407 bp, Homo sapiens
  misc_feature (289)..(289): n is a, c, g, t or u
gtttcctgcttggggaaatgttcacacccccttgtggatacattgtccagcccagagtttgtcctccctggatatgttttgaattaatgacggccgcacctcctttcctgtatttatttggaattgcctggtggaaggaggactctgctgcactcactgactgtgtgatctttggtaaatatcttaccctctctgggcttagtttccctagtggtaaagtggaaatagtgataactatcttagatagctgttgtgatgcccacatgagatagcatctgggctttacccnttcccctcggtctgggcaataacgggttaccttgcaaggattgggcagaaagccttagaggtatggtgctttgcagatggtcaccgttgtgattaatgtgggtgagttccatgagaga

SEQ ID NO: 585 - DNA, 2324 bp, Homo sapiens
gatgtggaccgtagtcggaccgttctaagctccaaaagctgcggaattcctcgagcactgttggcctactggtctgcttaaaattctgtttttaaaacccagtttcctagttttccaggcaaatagctacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttaggtgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaaggaaaaaaaaaaaaaaaaaaaaaaaaaaaaaaaaaaaaaaa

SEQ ID NO: 586 - DNA, 1179 bp, Homo sapiens
atgggttctctcagcacagctaacgttgaattttgccttgatgtgttcaaagagctgaacagtaacaacataggagataacatcttcttttcttcgctgagtctgctttatgctctaagcatggtcctccttggtgccaggggagagactgcagagcaattggagaaggtgcttcattttagtcatactgtagactcattaaaaccagggttcaaggactcacctaagtgcagccaagctggaagaattcattccgagtttggtgtcgaattctctcaaatcaaccagccagactctaactgtaccctcagcattgccaacaggctctacgggacaaagacgatggcatttcatcagcaatatttaagctgttctgagaaatggtatcaagccaggttgcaaactgtggattttgaacagtctacagaagaaacgaggaaaatgattaatgcttgggttgaaaataaaactaatggaaaagtcgcaaatctctttggaaagagcacaattgacccttcatctgtaatggtcctggtgaataccatatatttcaaaggacaaaggcaaaataaatttcaagtaagagagacagttaaaagtccttttcagctaagtgaaggtaaaaatgtaactgtggaaatgatgtatcaaattggaacatttaaactggcctttgtaaaggagccgcagatgcaagttcttgagctgccctacgttaacaacaaattaagcatgattattctgcttccagtaggcatagctaatctgaaacagatagaaaagcagctgaattcggggacgtttcatgagtggacaagctcttctaacatgatggaaagagaagttgaagtacacctccccagattcaaacttgaaattaagtatgagctaaattccctgttaaaacctctaggggtgacagatctcttcaaccaggtcaaagctgatctttctggaatgtcaccaaccaagggcctatatttatcaaaagccatccacaagtcatacctggatgtcagcgaagagggcacggaggcagcagcagccactggggacagcatcgctgtaaaaagcctaccaatgagagctcagttcaaggcgaaccaccccttcctgttctttataaggcacactcataccaacacgatcctattctgtggcaagcttgcctctccctaa

SEQ ID NO: 587 - DNA, 822 bp, Homo sapiens
gatcctctttccctcttccccaccctcattataggctgcgaagcctcctctctgcacctgataacaaaacgtcatatgagaagcatggtagatccttagcatcaaaggttgaggactcttattctgattataagtagtggctcttgactacaatcaagtctcaaataatagtgtaagagaataaagcagaataataagactaagttaacagtttaggcttctttggaatcatgcgggcctagatgaaaatcccaacactgtcctttactagctaagtgaccttgagcaactgattacaccctttgatgcctcagttttctcctctgtgttgtggggtaatagtaatatctacttcctggggttgttcgtgaagattaattaacaattatacttgtcaaagctttagcacagtgccctgtatgttatttccttggccaaactttcttactctgccatttgttcaatgtcctaatgagcatgaacactacattaggtatcatgcagaacactctaaagataagtattatgatctctatttcacagataaggaaatttaaactgggagaggctaaagggctgacttgcccaaggtcacttgaaactaatatgccagcagagacagaattaggagccaagtatatttaagagccaagtgtattgaacctaaaatctgggctcctaaataccaagcttcactggctctctggtcccagtgagagttggtgctaaaaagtattccggaatgaaaagttctcttccagagaccctggccttccaaagcggtcacctgatagggaagtcttacggctaggaagttacaaa

SEQ ID NO: 588 - DNA, 3129 bp, Homo sapiens
cgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagtttctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagaaaaaaaaaaaaaaaaaaaaaaaaa

SEQ ID NO: 589 - DNA, 3116 bp, Homo sapiens
agcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcagctcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaaaaaaaaaaaaaaaaaaaaaaaaaaaaaaaaaaaaaaaaaaaaa

SEQ ID NO: 590 - DNA, 570 bp, Homo sapiens
ttttccggttgcggcgccgcgcggtgaggttgtctagtccacgctcggagccatgccgtccaagggcccgctgcagtctgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaaaaaaaaaaaaaaaa

SEQ ID NO: 591 - DNA, 5925 bp, Homo sapiens
  misc_feature (5402)..(5402): n is a, c, g, t or u
cttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcagtcccctgggaagacgggtctcccctcgttgcctttgtagtggagaaggtggacaagtggcagtcggcgtgatcgcagggaagcggggccggcgcgggcgcgacgggtccaggcgagccccgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtacgattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagaaggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgttggaaatgacagtgaaggcccactgtgtgaattgctttttttcttcctgactgcaatcttccaggcaatagctgaagaagaagaggaagtagccaaagagcaactaactgatgctgacaccaaaggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatgttcactgaagatgaagatgacccaggatcacataaaagaggcagaagggggaaaagaggacaaaatggatttaaagaatttacaaggcaagaacagatcaactgtgtaacaagagagcttcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttgtagaagactgtcctttagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttccaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaaacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttganatcattcatgtgtccagagatcttggaaaatattttttcacccacgatttattttgttattgatgatttatttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctggaaaatgttccttaatgttttaaaccttttactgtgtttttattcctctaacttccttaatgatcaatcaaaaaaagtaacaccctccctttttcctgacagttctttcagctttacagaactgtattataagttctatgtataattttaactgttcaaataaaatacatttttccaataaaaaaaaaaa

SEQ ID NO: 592 - DNA, 468 bp, Homo sapiens
tttttttttttttttttaaatgtacacctcctttaatctgatttttctcctttttgaaacagggtctccctgtcacccaggctggagtgcagcagtgcaatcacagctcactgcagccttgacatcccagggttcaagcgatcctcccgtctcagcctcccgagtagccgggaccacaggagcgcaccaccacacccggataattttttgtagagatggggtttcaccgtgttgcccaggtcactctcaaactcctgggctcaagcgatctgcctgccttggtcttccaaagtcctgggattataggcgtgagccaccatgcccagccttaatcattttaagtggaaatgtaaccattttaggataatgtcctacaaaaacgtgagtacaagcaagcaaagacatttgcagaaagattttcacagatgatgtgagtctaatgccaaaaaactaaacacagccttttgg

SEQ ID NO: 593 - DNA, 1154 bp, Homo sapiens
gggggccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagccaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctcaaaaaaaaaaaaaaaaaaaaaaaaaaaaaa

SEQ ID NO: 594 - DNA, 434 bp, Homo sapiens
  misc_feature (8)..(44): n is a, c, g, t or u
  misc_feature (263)..(372): n is a, c, g, t or u
  misc_feature (408)..(408): n is a, c, g, t or u
  misc_feature (423)..(423): n is a, c, g, t or u
tacaagcnnnnnnnnnnnnnnnnnnnnnnnnnnnnnnnnnnnnnaaagaagtaaaatctttatcatgaaatttatatgtaaaagaatcactcagtaaagacaatttccataaaataaaaatggatatggatactatttaactatgttgtattaaaaaaaactgatcaaagaattggtttaatggaaaatgctctggaaaattcttttgcaacagttcatcgctgttgatataatcctaattaaaattatcggactccagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagaaagttgcacgtgtgcacgtttccttgccgcngaaggtaaaaaaaanaaaaaagagga

SEQ ID NO: 595 - DNA, 1424 bp, Homo sapiens
ggcacgagggccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggaggtctccctctgatgccgagccgaagctggacggtactgctgccatctcggctcactgcaacctccctgcctgattctcctgcctcagcctgccgagtgcctgcgattgaaggcgtgcgccgccacgcctgactggttttcgtatttttttggtggagacggggtttcgctgtgttggccgggctggtctccagctcctaaccgcgagtgatgcaccagcctcggcctcccgaggtgccgggattgcagacggagtctcgttcactcagtgctcaatggtgccaaggctggagtgcagtggcgtgatctcggctcgctacaacctccacctcccagcagcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgcctcttcccggccgccatcccatctgggaagtgaggagcgtctctgcccggccgcccatcgtctgagatgtggggagcacctctgccctgccaccccgtccgggatgtgaggagcgtctctgcccggccgccccatctgagaagtgaggagcccctccgcccggcagccgccccgtctgagaagtgaggagcccctccgcccagcagccaccccgtctgggaagtgaggagcgtctccgcccggcagccacctcgtccgggagggaggtcggggggtcagccccccgcccggccagccgccccgtccaggaggaaactcttggatgatgtactgaccaaaacagggaataacctaacagagaggaagacagggattttaggaaaccggagatcacacaggaaggaggtaaagggaaatcccaggatgatggcaaagggaagtccccaaacaacagctgtgcaacaagaataaagaacaatcagaggacctcttgagcccagaggtcaaggctgcggtgagccaaggtcgtgccactacactgaagcctgggcaacagagtgagaccctgtctcaaaacagaaaaggacctatcagccccaagtggagcagaacagagggatttgggaggaatgtcctcagaaaaagatattaaaacacagttatctgaaaaaaaaaaaaaaaaaaaaaaaaaaaaaaaaaaaaaaaaaaaaaa

SEQ ID NO: 596 - DNA, 2120 bp, Homo sapiens
cgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcacaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacagggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaacttaaaaaaaaaaaaaaaaaaaa

SEQ ID NO: 597 - DNA, 551 bp, Homo sapiens
tttttttttttttttttgcacacacatatctttttatttgagagtttaaaaggaaatctgaggtccagaggatcacagagcctcttgttctgctatcaaaggaccaataagaagcaaactgatattacagggcaaatgttcccagacagcccagcctgctccccttaggaatgagtgtccctggagggggagagcctggaaccaaagccccgccaggaactgcttcccctaaactgaggttctctgaaaaaaatgttcgcctggctgataaagccgcctcttaacagagcccagacacttctgtgcttcccctgggttgctaattgaggacactaaagccctaagagataccccaggtcgggggaaggggccccaagacctagacctccggtggcgaccatgcccttgagaggatgggagctgaattggagcacgagattatttatcatcgctggatgaagcttccagctagagctcagtatttcctctttttctgggctcagacagacacagactggaaggaatcctgtccgtttggctgtgggagtgtt

SEQ ID NO: 598 - DNA, 1458 bp, Homo sapiens
ttagttcctcggggagcccctggtgccccggatacggctgattttgtcgtgtgggacctgttctggctgctccagccccaggaaggacccaggacacccggaagccggaaatggactcagtggcctttgaggatgtggctgtgaacttcacccaggaggagtgggctttgctgagtccttcccagaagaatctctacagagatgtgacgctggaaaccttcaggaacctggcctcggtcggaatccaatggaaagaccaggacattgagaatctgtaccaaaacctggggattaagctaagaagtctggtggagagactctgtggacgtaaagaagggaatgaacacagagaaactttcagccagattcctgattgtcacctgaacaagaaaagtcaaactggagtgaaaccatgcaaatgcagcgtgtgtgggaaagtcttcctccgtcattcattcctggacaggcacatgagagctcatgctggacacaaacgatctgagtgtggtggggaatggagagagacgccccgtaaacagaaacaacatgggaaagcctccatttcccccagtagtggtgcacggcgcacagtaacaccaactcgaaagagaccttatgaatgcaaggtgtgcgggaaagcctttaattctcccaatttatttcaaatccatcaaagaactcacactggaaagaggtcctataaatgtagggaaatagtgagagccttcacagtttccagtttctttcgaaaacatggaaaaatgcatactggagaaaaacgctatgaatgtaaatactgtggaaaacctatcgattatcccagtttatttcaaattcatgttagaactcacactggagaaaaaccttacaaatgtaaacaatgtggtaaagccttcatttccgcaggttaccttcggacacatgaaatcagatctcacgcgctggagaaatcccaccaatgtcaggaatgtgggaaaaaactcagttgttccagttcccttcacagacatgaaagaactcatagtggaggaaaactctacgaatgtcaaaaatgtgccaaagtctttagatgtcccacgtcccttcaagcacatgaaagagctcacactggagaaagaccttatgaatgtaataaatgtggtaaaaccttcaattatcccagttgttttcgaagacataaaaaaactcatagtggagaaaagccatatgaatgtacaaggtgtggtaaagcctttgggtggtgcagttccctccgaagacatgaaatgactcacactggagaaaaaccctttgattgtaaacagtgtggtaaagtctttactttttcaaattaccttagacttcatgaaagaactcatttggccgggcgtagccagtgctttggcaggaggcagggggatcacctgagcccaggagtttgagaccagcctgggcaacataagaaggcccccggaattc

SEQ ID NO: 599 - DNA, 3176 bp, Homo sapiens
acccagggacctatcacacaaatataagaactattcattctttaaggcatgtatttccaagcctttgtatttttttccatgcttagggttggcaaggaatatatatatatttgtacaaatatatatgtgtatatgtacaaatacatgtatatatagtacaaatatatatatatatttgtacaattcttcagactttgtagaatttgtataatgtcgtatcttgctttttttaaccactgatgttataagcatatttatgccacttcattcattttagagacttaataataaatgatctagtggataatttatcattccctgatggagaaaaatttagctttgtttattttagagttataaacgatgctgggtcaggtatctttatgtttgaagatggctccatatttgggttgtttccacagaactctttcctagaaatgctttttctaggttaatggctacagatatttctaggcacctgacatattgacacccacctctaaagtatttttatgatccacaactagcgtttaacacagcgccctagtcactacatgactaataaatagacaaatgactgaaacatgacctcatgctttctattcctccagctttcattcagttctttgcctctgggaggaggaagggttgtgcagccctccacagcatcagcccatcaaccctatccctgtggttatagcagctgaggaagcagaattgcagctctgtgggaaggaatggggctggagagttcatgcacagaccagttcttatgagaagggactgactaagaatagccttgggttgacatatacccctcttcacactcacaggagaaaccatttccctatgaaactataacaagtcatgagttgagagctgagagttagagaatagctcaaagatgctattcttggatatcctgagcccctgtggtcaccagggaccctgagttgtgcaacttagcatgacagcatcactacgcttaaaaatttccctcctcacccccagattccatttccccatccgccagggctgcctataaagaggagagctggtttcagacttcagaaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacgtgagtctgagtttcgttgtgggtatcaccactctctggccatggttagaccacatcaatcttttcttgtggcctaaaagcccccaagagaaaagagaacttcttaaagggctgccaaacatcttggtctttctctttaagacttttatttttatctctagaaggggtcttagccccctagtctccaggtatgagaatctaggcaggggcaggggagttacagtcccttttacagatagaaaaacagggttcgaaacgaatcagttagcaagaggcagaatccagggctgcttacttcccagtggggtatgttgttcactctccagctcactctaggtctcccaggagctctgtcccttggatgtcttatgagagatgtccaaggcttctcttgggttggggtatgacttcttgaaccagacaaaattccctgaagagaactgagataagagaacagtccgttcaggtatctggatcacacagagaaacagagaacccactatgaagagtcaaggagaaagaaggatacagacagaaacaaagagacatttctcagcaaaaatgcccaaatgccttccagtcacttggtctgagcaagcctgccttcctcaactgctcggggatcagaagctgcctggccttttcttctgagctgtgactcgggctcattctcttcctttctccacagttgctgctgacacgccgaccgcctgctgcttcagctacacctcccggcagattccacagaatttcatagctgactactttgagacgagcagccagtgctccaagcccggtgtcatgtaagtgccagtcttcctgctcacctctatggaggtagggagggtcagggttggggcagagacaggccagaaggctatcctggaaaggcccagccttcaggagcctatcggggatacaggacgcagggctccgaggtgtgacctgacttggagctggagtgaggcatgtgttacagagtcaggaagggctgccccagcccagaggaaagggacaggaagaaggaggcagcgggacactctgagggccacccctactgagtcactgagagaagctctctagacagagataggcagggggcccctgaaagaggagcaagccctgagctgcccaggacagagagcagaatggtggggccatggtgggcccaggattcccctgctggattccccagtgcttaactcttcctcccttctccacagcttcctaaccaagcgaagccggcaggtctgtgctgaccccagtgaggagtgggtccagaaatatgtcagcgacctggagctgagtgcctgaggggtccagaagcttcgaggcccagcgacctcggtgggcccagtggggaggagcaggagcctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcagcctgtgtaggcagtcatggcaccaaagccaccagactgacaaatgtgtatcggatgcttttgttcagggctgtgatcggcctggggaaataataaagatgctcttttaaaaggtaaaccagtattgagtttggttttgtttttctggcaaatcaaaatcactggttaagaggaatcataggcaaagattaggaagaggtgaaatggagggaaattgggagagatggggagggctaccacagagttatccactttacaacggagacacagttctggaacattgaaactacgaatatgttataactcaaatcataacatgcatgctctaggagaattc

SEQ ID NO: 600 - DNA, 130 bp, Homo sapiens
gtaactagaaatggcagggtaaggagtgtttgcctgacatcgtctcgtttttacggaagagggcccctcacgatgtgcccatcagccccacctgaaatagcaagaaatcttcttcagcagagagcgaata

SEQ ID NO: 601 - DNA, 200 bp, Homo sapiens
ttttttttttttttttttttttttttttttttttttttttttttttttttttttttttttttttttttttttttttttttggggcccccggctttttttataaaaaccagggggaaggtttgggccaaaccccccaggctttgggttttcccccccccccccgggaaagggggcccccccccccccccaaaaaaaaccca

SEQ ID NO: 602 - DNA, 921 bp, Homo sapiens
gcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattacca

SEQ ID NO: 603 - DNA, 2591 bp, Homo sapiens
ctcagactgtccttcctctctggactgtaagaatatgtctccagggccagtgtctgctgcgatcgagtcccaccttccaagtcctggcatctcaatgcatctgggaagctacctgcattaagtcaggactgagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttctccccaactgaagaactaaggaagcggtggattcaccagctcaaaaacgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgttggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctggggatgcacctcttctttgattccctgggatagtggcttctgagcaaaggccaaaaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaattctagaaagcttaaaaaaaaaaaaaaaaaaa

SEQ ID NO: 604 - DNA, 594 bp, Homo sapiens
  misc_feature (520)..(520): n is a, c, g, t or u
tttttttttttttttgtacttttgttcatagatcggcacttgactttgaacctggcaccaaaaggcacaatatctgataccctgtacaagagctattagagatgctgccatatggatgggcaaaactgagccaatcccacttaggaatggaaggcttggacatggaagggaggatataaacgaggagttggagaaaaacgcaagcccagtttttgctagagtggaaatgaaagtgggaatgagggtcttgtttttagtcctctaaggaccaggaagcaattttaaaacttccttggtttttctgaaagcagcatattcaaaatgccagcaaaaactcctaacaactgcaaaaccaaaagaggatcaaagctcaccaacatcccttcttattgctgaaaggctctaaaattcaggatgccctgttcccttgtaaaagggaaaataattaagtctgatttatggtaatcataccacatcacacttctaaaaaaatattcaagtgtgtgaccaggggacgttngacaccattttattaaccttcaacttcagtggaaaaataaaaccttttccaagtgccattttcatcacaagact

SEQ ID NO: 605 - DNA, 2338 bp, Homo sapiens
agcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcctttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaaaaaaaaaaaaaaaaaaaa

SEQ ID NO: 606 - DNA, 1723 bp, Homo sapiens
actccgaatgcgaagttctgtcttgtcatagccaagcacgctgcttcttggattgacctggcaggatggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtcgtacctagctcagctgcaaccatcaaacttcatgatcaatcaattggcacacagcaatgggaacatagccctttgggagagttgtgtccaccaggatctcatagatcagaacatcctggagcctgtaaccggtgcacagagggtgtgggttacaccaatgcttccaacaatttgtttgcttgcctcccatgtacagcttgtaaatcagatgaagaagagagaagtccctgcaccacgaccaggaacacagcatgtcagtgcaaaccaggaactttccggaatgacaattctgctgagatgtgccggaagtgcagcagagggtgccccagagggatggtcaaggtcaaggattgtacgccctggagtgacatcgagtgtgtccacaaagaatcaggcaatggacataatatatgggtgattttggttgtgactttggttgttccgttgctgttggtggctgtgctgattgtctgttgttgcatcggctcaggttgtggaggggaccccaagtgcatggacagggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctgggaccggcagaagctgaagggtctcagaggaggaggctgctggttccagcaaatggtgctgaccccactgagactctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaaaagagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaatacaaaaattaactggaaaaaaaaaaaaaaa

SEQ ID NO: 607 - DNA, 1449 bp, Homo sapiens
ctggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaacc

SEQ ID NO: 608 - DNA, 498 bp, Homo sapiens
  misc_feature (11)..(39): n is a, c, g, t or u
  misc_feature (380)..(475): n is a, c, g, t or u
aggtacaagcnnnnnnnnnnnnnnnnnnnnnnnnnnnnnagatcaaataaagactaatgatattgatttggatacggtgaataagctggacaagatgttgaggagagggggtaaaacaagtttacattaaatatactaacaataacgattgggtacagatttgtaagtgatggtgatggataaaaactgaataagaatacaaacctaaaatataatgaaaatgaaaaaaatatcttttatcttttttaataaagaagggggacggggtcttggattagtataaatataacaataatggaaaagttgaatatgttaaggaataagaattaatctcatttaaagcctcaaaacaaccatgaaaaggattagaaacattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttaaaaaaaaaaaaaataga

SEQ ID NO: 609 - DNA, 3216 bp, Homo sapiens
gcggacggtgagtggggatggactggagttgaagagctcgagatgaagggcttgagggcgtgtgttatttgttttcttcaagcatttggtcgagattaagaattaaaaatgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtcaaaagaaaataaagaagaaaaaaacccagactaaaaaagaaatcgattcaaaaaatctagttgagaaaaagaaagaaaccaagaaggctaatcacaagggttctgaaaataaaactgatttagataattctataggaattaaaaaaatgaaaacctcatgtaaatttaagatagattcaaacataagtccgaagaaggatagcaaagaatttacacaaaaaaataagaaagagaaaaaaaacattgttcaacatactacagactcttctctcgaagaaaaacaaaggacattagactcaggcacctctgaaattgtgaaatctcccagaatcgagtgttctaagacaagaagagaaatgcaatcagtggttcaactcataatgacaagagacagtgatggttatgaaaactcaacagatggtgaaatgtgtgacaaagatgctctggaggaagattcagaaagcgttagtgaaataggaagtgatgaggaatctgaaaatgaaattacaagtgttggtagagcttcaggtgatgacgatggaagtgaagatgatgaagaggaggatgaagatgaagaggaggatgaagatgaggatagtgaggatgatgataaaagtgacagtggccctgatcttgcaaggggtaaaggaaatatagaaactagttctgaagatgaagatgatacggcagatttgtttccagaagaatctggttttgagcatgcttggagagaattagataaagatgctcctcgtgctgatgagattacacgtcgattagcagtttgtaacatggactgggatagattaaaggcaaaagatttgctggctctgttcaattcatttaaacccaaaggaggtgtaatattttccgtcaagatatatccttcagaatttggaaaggagaggatgaaggaagagcaagttcaaggaccagtagagctattaagtattcctgaagatgccccagaaaaagactggacgtctagagaaaaattgagagattatcaattcaaacgactgaagtactattatgcagtagtagactgtgattctccggaaacagctagtaaaatttatgaggattgtgatggcctggaatttgaaagtagttgttctttcatagatctaaggtttataccagatgatattacttttgatgatgagcctaaggatgtagcctcagaagtgaatttaacagcatataaaccaaaatatttcacttctgctgcaatgggaacatcaacggtggaaatcacttgggatgagactgatcatgaaagaattacaatgctcaacaggaagtttaaaaaggaagagcttttggacatggattttcaagcctacttagcttcctctagtgaagatgaagaggagatagaagaggagctacaaggtgatgatggagtcaatgtagaagaagatgggaaaacaaagaaaagtcagaaggatgatgaagaacaaattgctaaatacaggcagctcttgcaggttattcaagaaaaagaaaagaaaggcaaagaaaatgatatggaaatggaaattaaatgggttccaggtcttaaagaaagtgcagaagagatggtcaaaaacaaattggaaggaaaggataaactgaccccttgggaacaatttttagagaagaagaaagagaaaaaaagactgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaatgttaacgatgcacggtttcaggcaatgtacacttcccacttgttcaatttggacccctcagatcccaatttcaagaaaacaaaagctatggaaaaaatccttgaggagaaggcccggcaaagagaacggaaagaacaagaacttactcaggcaataaagaaaaaagagagtgagattgaaaaggaatcacaaaggaagtccattgatcctgctttgtcaatgttgattaaatctataaaaaccaaaacagagcagtttcaagcaagaaaaaagcaaaaagtcaaataactggatgttacttatttttgaactgaatacatcttttcctaaaatgtacaaaaataataggagggaatatttattgggaacaaagctatctttcaagaacatgaataaaatctttttctggacatagtaaaatttttctccataaataattgtacttaattgtggatgactgacaaatttttattgtatattcctacagatcagtcataattaaattacctgcattatagggtttataaaatttttatattttacaatgttcagttctaactagtggaaagttactctagctttttaaaaggctgtttacaattctgtgtaaaaatagagcagtatctactcaagtttgtgtaaatgttagggataatttgaaaaatatatatatttaatacattaatttctctggaagcaggaggcatgtttaaataactattaaaataatttatttttctagccataaaggatggaagtcaagaactttttgttgtttagtcatgttaagtatagtttatgaaattaacttgtaaataaaagtgtaaaatattttcatta

SEQ ID NO: 610 - DNA, 2155 bp, Homo sapiens
tgggggcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcgccaaataccaggctaccatggtctacaagactctcttcgctctttgcatcttaactgcaggatggagggtacagagtctgcctacatcagctcctttgtctgtttctcttccgacaaacattgtaccaccgactaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagcttgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccaacagaggagtccagctctgaccacacacccacttcacatgccacagctgagccagtgccccaggagaaaacacccccaacaactgtgtcaggcaaagtgatgtgtgagctcatagacatggagacaccaccacctttcccagggtgatcatgcaggaagtagaacatgcattaagttcaggcagcatcgccgccattaccgtgacagtcattgccgtggtgctgctggtgtttggagttgcagcctacctaaaaatcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggaggaggatttgggttgttttgttaggggttactttcaggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagggaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaaaaaaaaaaaaaaaaaa

SEQ ID NO: 611 - DNA, 2333 bp, Homo sapiens
ggcacgaggctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatctttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatattattttattacatatcattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattgatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctgataaaaaaaaaaaaaaaaaa

SEQ ID NO: 612 - DNA, 2010 bp, Homo sapiens
attcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctg

SEQ ID NO: 613 - DNA, 1263 bp, Homo sapiens
ggcacgaggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataataaatataatttaagaaaaaaaaaaaaaaaaaaa

SEQ ID NO: 614 - DNA, 447 bp, Homo sapiens
ttttttttttttttttttggtgaaacaatttattagccatggttcagaataatacaaaaataaaggtgtggctttatttacacacactcttgaagctcttggcattcagcggacagcaaacaccatactcagagtgatggaattaatagcatttagggtaagcaaggaccagtgtgagactgggcccaggaaatggggagggaatgtgaggagaaacagggaatgacattaaagaagaaacagacaccttggagaatttatgactcctttctctatgtcatgtccagaagaggcaagtctacagagatcaaagtagcctaggggtgcctagggatggggaggttggggtggcgactaaggggggctggatttcttttgggggtagtcaactctaagacggactgtgctgatggctgctgaactgtgactatactaaaccggcatcaa

SEQ ID NO: 615 - DNA, 2372 bp, Homo sapiens
gcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcagtagtcagtccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccg

SEQ ID NO: 616 - DNA, 3198 bp, Homo sapiens
ccgcatgctcccgtatctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgtaaaaatgaaccagcagcgttcaaggaggttcagggccatcaaaagaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagctgatgctgatctcattatgcttggccttgccacacatgaaccgaactttaccattattagagaagaattcaaaccaaacaggcccaaaccatgtggtctttgtaatcagtttggacatgaggtcaaagattgtgaaggtttgtcaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgacatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgaatttgaaaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgtgctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactggggaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattaatgcttataaacacatttgaggaataggaggtccgggttttccataatgggtaaaatggaaccagctg

SEQ ID NO: 617 - DNA, 422 bp, Homo sapiens
tgagtgtaaagaaaggtttactccttgtatcatcccctccccgtggactgcttcaattctatcggggacaggccagtccctggaggctgcaaggagccacaaacctttcccagctcacactctgcacccctcagtctctgctgctaaagaatcagactcaggtagatggggtgtccacagtctgtcctcattacccagtcataccgggtagcatggcccgagagagcccttatctctccccaccttaaaaccctcagcatcacacagcaggaaccagtccacagggcttaccaaggatacgcagtgaaaacagaataatgtctgttacaaaccccctaaacctgagatggctgaagagccagattcctgcaccccatctgactcccccaggcagtgggagatgacccaaagcccccattccc

SEQ ID NO: 618 - DNA, 287 bp, Homo sapiens
tttttttttttttttcatcagcaatttcaattttatgttttctacttatttttatataaaaatacaatgcaacaaaatattcatatattgcacaaacagggatgtgcatacaaagatgctaacaacattggctggtaataggctttaccatgttatgatctaaatgcttgttcatcaaaaaatgtacaaaattctaagtttggcatccaaaagggggcttacagttattgaatatttttcccagccctattttaaatcaaattcaagtttgcctatgacaaagactg

SEQ ID NO: 619 - DNA, 515 bp, Homo sapiens
tttttttttttttttttttttttttttttttctgcttaatggcatgagagctccatgaaggaatttattagatacaccctgattctccactgccctaacacacgatactgagttgctaatgtccacattcagcaccaggggaaattcgtgcatcacatgacatcgcctcattaaagctgtcagcataactttaccaaacaagttatataacaaccaagaagccactggtacaggataatattcagaatgtgacatgtaaaaattgcaataagtagaatatattttttatgttgttgaacaaaagaaaattgaaagaattaaagcaatccaagggcctagaagcaagtgaattctctgatacctgtgagtaaggctactttaggacagcccatgaatccattcctcgggttgttctgagctccttgagaaatggccccaactgggtttttggagtgaacctggttcaatacagattgccttaggatgttcactgaaagtttcggcttgctctggac

SEQ ID NO: 620 - DNA, 1843 bp, Homo sapiens
ggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtgaaggtacaagtaagaagctggcgaaacatagagctgcagaggctgccataaacattttgaaagccaatgcaagtatttgctttgcagttcctgaccccttaatgcctgacccttccaagcaaccaaagaaccagcttaatcctattggttcattacaggaattggctattcatcatggctggagacttcctgaatataccctttcccaggagggaggacctgctcataagagagaatatactacaatttgcaggctagagtcatttatggaaactggaaagggggcatcaaaaaagcaagccaaaaggaatgctgctgagaaatttcttgccaaatttagtaatatttctccagagaaccacatttctttaacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatatagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccccggg

SEQ ID NO: 621 - DNA, 267 bp, Homo sapiens
tttttttttttttttgcctcttccacttggtctgcagtctgattcactcctttactttcctccaatatactgacccttgggacttgggtattgctggcctgctttgggccctcaggctctttgcctgctggtttctgagctttccatagtcacagtctggttttaggcagaaactgtacctccatttgcaatcaacccttttgcagctgtgccttacgcttcttactgtgtttttaccaattcatctggaacaaactagaaaaggaa

SEQ ID NO: 622 - DNA, 363 bp, Homo sapiens
  misc_feature (316)..(316): n is a, c, g, t or u
ctttgccatcaggtggtggtcaacgaaggggcccttcttcagcgaacgagtcatggcctagcccttacttcttgcgacgcgagacgatgaacgtctgcgtgcgcttgttgttgcgagtgcggtagcccttcgtcagggtgttccacggcgacacagggacctggccctcgccggtgcggccttcgccaccaccgtgcgggtgatccaccgggttcatggcaacgccacgaacggtcgggcggatgcccttccagcggatcgcgccggccttgccgtactggcgcaggctgtgctcttcgttgctcacttcaccganggtggcgcggcagtcgatgtgcacgcggcggacttcgccggagcgca

SEQ ID NO: 623 - DNA, 345 bp, Homo sapiens
acaatttcacacaggagatctcagacagatgactatatccttccctgggtacttgcagggtaagcacatcccctcgaaatagcagcagctctaaacatgaaattcttcctggaggattttcttactcttgagttctattctaccaaattttttgagcacttactgtcaggcattcagaatgtgagcaatgacaataatttacctacacttttgcacttacagtatgctgggcccagttgattctcaaaacagttctgggaattagctataaaaatgcccccatcttacagatgaggaagctcaggctcagaaaggcaaaaaaaaaaaagccctatagtgagtcgt

SEQ ID NO: 624 - DNA, 417 bp, Homo sapiens
gcaaaggaaaatgaatattwattcaatgtccagattggggaggggtctgtgtgtttaacaggaaaagwtacagaaaaamacctatcacamaggaaaagataaatatgtytgaytatythammaggtgaaacccataaccaaaatttaaaggcaaattcacacaagtggaaatacagatgcccaactatcgtacaaagrgaaccatgwtcaaggtcactaacaagcaaagaattttmagtttttbbtgtttttbgttgtttttyatttgrgacggrgtytcgytctgtcacccaggctggrgtscagtggcgcgatcttggytcactgcaacctccgcctcctgggttcaagcaattctctgcctcagcctcccaagtagctgggdttacaggcgcccgccaccacgcccggctaatt

SEQ ID NO: 625 - DNA, 2422 bp, Homo sapiens
gtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggccgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttaaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctaaaaaaaaaaaaaaaaaaa

SEQ ID NO: 626 - DNA, 3115 bp, Homo sapiens
ccaccatatcggtcccgtatttcacattgataaggtcctgtttcatttctcgtgacattgggtagaatgaggatcctgttttcaatgggtcgctttaccctgggactgacagggaggctctgaccatttagccaccaaatgtaggtgtagttctcactcttaggttcaccccgcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcacagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaatgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggccggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagccactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaaccac

SEQ ID NO: 627 - DNA, 2889 bp, Homo sapiens
agatcctgtggttcactgtgagacctccgcctctctcgtctgcctcacgctgccccctcgcacccccaaggtatgacggcatttgaacaatgcacgtgcccatctagagccttggggtgggcctgtgagagagtggccgcccaccccagtccccaccaggtgcatagtcctgcggctaagtcagggcggttgtaacaaaggctcagaccctccaactaccaggctgtgttgtgacgaggctgctggagccccaggcaccatgacgggaatgggtgaatccacccacagtgggtgactctcaatgtgatactagcccggtacacttagacacccaaaaatcaacgcggcagacgttgtatccccaggagaaggacccccccgaacagacacgtgggacaatggcaagcatggccatccctgaggacaatggcaggacccagagtgcctctctcctcctcaaggcatgaactggcccctccagatacagggacaaccttttcttcccacctcggcctgtaacagacacgacacaggccatacccttggctagagtcactgcaacatgatccagagggtgactgtgaaaggagccagcggggctgctgtgtcggttttcctggagacacggaaatgggtacaaacttaaaacatctgggcagaggtctttgggataaagtccagaaaatcacagctggctccatcattcaggaattgatttcccccatgacaccatcggatgcaaccttgtccctgccgcctccagctctccttgatttcccctctgagctcacaaaaagaaacaaaagctcagagaggctgaataactttcccagcttacacggaggagctgggtttgaatccagacatcacactgatcagcacgcagacccgcagggtttcatactcttccggcatttcacgtacacctctctccatctcaccgcctcaccataggaggtgaggcctattcctatccgcacaatctgacagggaaattgagactcagagaggttaagtaacttgcctaaggccacatagctcgtaatcagggcagcagggattccaggccgagcaggcaggcccctgatccaggctcctagcctgctgcccagggaggtcagagctggaaaccacttccacagcacaaggagactctgcttggactgtgcttggcctcacgtgacctctgacctccctggccctcctgtgaccctgacaggtgtgctgagcttctgaagggtgggaaggcctgcaaggggcctgcgtgcattctgtgtgcatcgacccaggacaccacggttggtgcctctgagttcatcacgtcgatcatccccgtcttctttctgctcaagtacttgatttgtcaacatgcacagaagggtgagacctggccatggtgctgcttgaatcttgttaacagttaggctctgattcaatagtctgggtggggcccaagactctgcatttctttttcttttcttttttcttttttgagacggagtcttgctctgttgcccaggctggagtgcagtggtgcaatctcagctcactgcaacctccccctcctgggttcatgcaattctcttgcctcagcctcccaagtagctgggactataggcacgcgccaccatgcctggctaatttttgtatttttagtagagatagggtttcaccatgccggccaggctggtctcaaactcctgacctcaagtgatctgcccgccttggcctcccaaagtgctgggattccaggcatgagcccccgcacccgccagactctgcatctctaaagtgctgggattccgggtgtgagcccccacgcccgccagactctgcatctctaaagcgctcccagggatgctgatgctgccatctgggggaccacgcttggagtactgcggccctggcaaaccatctcttccaggaagctgcatcttgctctgccttcctcccctgccagcagctcagccctgatcatctctcacctgaggcccttaaaagcctcccaatcagcctctctgcccccgacccccaggcctgcacccggtcctctcccgcactgcagcccagcgctgtctaactgagcgacctgggttacatttcagcatcccccatgtgattccctgctgtccacaccagcaagtctctgagtgcaacccgcagccacgtgcatcataatcagctgagctgctggtgaaggggtagattcctgggcctcacccctgacagatcctatcccagcccctgcgggaggggcccaggaatgcagccagttcaccagctgccctgccaaagcctggcaatctctgggcctagaggcttgagaacggtcaagcagctcgccctggctcccctgggagccaccctagcctggaacgctgcacaccagacaggggtggtagagctcctggccattcccaaatgccccacacccagcagcgcctggaatgtgctcatgcaggttcctcgtgacatggacacacccccttccccatcctacccacatgtccccagcccaggcctcgttcccactcccccaggatgccccaaccctccaagggaacaaagagaatgctcttccctttctccagaagcccagcacccgggccacatagtcaagcgctttgtctttgaaacataaaaatagctatagaagggctccgttagctggcatcggccagagagagaacatttccatataattagagcttaccctttcatatggaaagttagacatttctctgtctaaggcgcctacgtagaatatgtaatttgaccttctttgggggaaattttggattgtctttgggatgataatataggaaatccctcgagggcttttaaaatgtaaagaacagaggtcccataaactaagtgaccccagaatgc

SEQ ID NO: 628 - DNA, 449 bp, Homo sapiens
tttttttttttttttttcaagcagtaaaattccatcagaaaagaaaagctctttagactagcaatgtatgtatgaggcacttatgggttagaaacacattcactgagaaacatttatttggaaccttttctgggctcagcactgagttaggttctagggattcggagataaataaaaccagttccagccctcaaggcactcagggaggcagagacatagagcagcaatcacattccagtgaagaaagtgtcaggtgaaagaatggtctggcagccaataagggcgctaacgggacctgaccccatgtgctggcccagagcacaggccctgctctagactgctttgggttcaaactctttctcttcacttactagctgtgtgtccttgggcatttttcttgacctctctgtgcctgagtttcctcttctgtaaaatgaaaattataacag

SEQ ID NO: 629 - DNA, 7391 bp, Homo sapiens
gctgcgcagcgctggctgctggctggcctcgcggagacgccgaacggacgcggccggcgccggcttgtgggctcgccgcctgcagccatgaccctcgcagcctgtccctcggcctcggcccgggacgtctaaaatcccacacagtcgcgcgcagctgctggagagccggccgctgccccctcgtcgccgcatcacactcccgtcccgggagctgggagcagcgcgggcagccggcgcccccgtgcaaactgggggtgtctgccagagcagccccagccgctgccgctgctacccccgatgctggccatggcctggcggggcgcagggccgagcgtcccgggggcgcccgggggcgtcggtctcagtctggggttgctcctgcagttgctgctgctcctggggccggcgcggggcttcggggacgaggaagagcggcgctgcgaccccatccgcatctccatgtgccagaacctcggctacaacgtgaccaagatgcccaacctggttgggcacgagctgcagacggacgccgagctgcagctgacaactttcacaccgctcatccagtacggctgctccagccagctgcagttcttcctttgttctgtttatgtgccaatgtgcacagagaagatcaacatccccattggcccatgcggcggcatgtgtctttcagtcaagagacgctgtgaacccgtcctgaaggaatttggatttgcctggccagagagtctgaactgcagcaaattcccaccacagaacgaccacaaccacatgtgcatggaagggccaggtgatgaagaggtgcccttacctcacaaaacccccatccagcctggggaagagtgtcactctgtgggaaccaattctgatcagtacatctgggtgaaaaggagcctgaactgtgtgctcaagtgtggctatgatgctggcttatacagccgctcagccaaggagttcactgatatctggatggctgtgtgggccagcctgtgtttcatctccactgccttcacagtactgaccttcctgatcgattcttctaggttttcctaccctgagcgccccatcatatttctcagtatgtgctataatatttatagcattgcttatattgtcaggctgactgtaggccgggaaaggatatcctgtgattttgaagaggcagcagaacctgttctcatccaagaaggacttaagaacacaggatgtgcaataattttcttgctgatgtacttttttggaatggccagctccatttggtgggttattctgacactcacttggtttttggcagcaggactcaaatggggtcatgaagccattgaaatgcacagctcttatttccacattgcagcctgggccatccccgcagtgaaaaccattgtcatcttgattatgagactggtggatgcagatgaactgactggcttgtgctatgttggaaaccaaaatctcgatgccctcaccgggttcgtggtggctcccctctttacttatttggtcattggaactttgttcattgctgcaggtttggtggccttgttcaaaattcggtcaaatcttcaaaaggatgggacaaagacagacaagttagaaagactgatggtcaagattggggtgttctcagtactgtacacagttcctgcaacgtgtgtgattgcctgttatttttatgaaatctccaactgggcactttttcggtattctgcagatgattccaacatggctgttgaaatgttgaaaatttttatgtctttgttggtgggcatcacttcaggcatgtggatttggtctgccaaaactcttcacacgtggcagaagtgttccaacagattggtgaattctggaaaggtaaagagagagaagagaggaaatggttgggtgaagcctggaaaaggcagtgagactgtggtataaggctagtcagcctccatgctttcttcattttgaaggggggaatgccagcattttggaggaaattctactaaaagttttatgcagtgaatctcagtttgaacaaactagcaacaattaagtgacccccgtcaacccactgcctcccaccccgaccccagcatcaaaaaaccaatgattttgctgcagactttggaatgatccaaaatggaaaagccagttagaggctttcaaagctgtgaaaaatcaaaacgttgatcactttagcaggttgcagcttggagcgtggaggtcctgcctagattccaggaagtccagggcgatactgttttcccctgcagggtgggatttgagctgtgagttggtaactagcagggagaaatattaacttttttaaccctttaccattttaaatactaactgggtctttcagatagcaaagcaatctataaacactggaaacgctgggttcagaaaagtgttacaagagttttatagtttggctgatgtaacataaacatcttctgtggtgcgctgtctgctgtttagaactttgtggactgcactcccaagaagtggtgttagaatctttcagtgcctttgtcataaaacagttatttgaacaaacaaaagtactgtactcacacacataaggtatccagtggatttttcttctctgtcttcctctcttaaatttcaacatctctcttcttggctgctgctgttttcttcattttatgttaatgactcaaaaaaggtatttttatagaatttttgtactgcagcatgcttaaagaggggaaaaggaagggtgattcactttctgacaatcacttaattcagaggaaaatgagatttactaagttgacttacctgacggaccccagagacctattgcattgagcagtggggacttaatatattttacttgtgtgattgcatctatgcagacgccagtctggaagagctgaaatgttaagtttcttggcaactttgcattcacacagattagctgtgtaatttttgtgtgtcaattacaattaaaagcacattgttggaccatgacatagtatactcaactgactttaaaactatggtcaacttcaacttgcattctcagaatgatagtgcctttaaaaatttttttattttttaaagcataagaatgttatcagaatctggtctacttaggacaatggagactttttcagttttataaagggaactgaggacagctaatccaactacttggtgcgtaattgtttcctagtaattggcaaaggctccttgtaagatttcactggaggcagtgtggcctggagtatttatatggtgcttaatgaatctccagaatgccagccagaagcctgattggttagtagggaataaagtgtagaccatatgaaatgaactgcaaactctaatagcccaggtcttaattgcctttagcagaggtatccaaagcttttaaaatttatgcatacgttcttcacaagggggtacccccagcagcctctcgaaaattgcacttctcttaaaactgtaactggcctttctcttaccttgccttaggccttctaatcatgagatcttggggacaaattgactatgtcacaggttgctctccttgtaactcatacctgtctgcttcagcaactgctttgcaatgacatttatttattaattcatgccttaaaaaaataggaagggaagcttttttttttctttttttttttttcaatcacactttgtggaaaaacatttccagggactcaaaattccaaaaaggtggtcaaattctggaagtaagcatttcctcttttttaaaaatttggtttgagccttatgcccatagtttgacatttccctttcttctttcctttttgtttttgtgtggttcttgagctctctgacatcaagatgcatgtaaagtcgattgtatgttttggaaggcaaagtcttggcttttgagactgaagttaagtgggcacaggtggcccctgctgctgtgcccagtctgagtaccttggctagactctaggtcaggctccaggagcatgagaattgatccccagaagaaccattttaactccatctgatactccattgcctatgaaatgtaaaatgtgaactccctgtgctgcttgtagacagttcccataactgtccacggccctggagcacgcacccaggggcagagcctgcccttactcacgctctgctctggtgtcttgggagttgtgcagggactctggcccaggcaggggaaggaagaccaggcggtaggggactggtcttgctgttagagtatagaggtttgtaatgcagttttcttcataatgtgtcagtgattgtgtgaccaaggcagcatctagcagaaagccaggcatggagtaggtgatcgatacttgtcaatgactaaataataacaataaaagagcacttgggtgaatctgggcacctgatttctgagttttgagttctggagctagtgttttgacaatgctttgggttttgacatgccttttccacaaatctcttgccttttcagggcaaagtgtatttgatcagaagtggccatttggattagtagccttagcaatgctacagggttataggcctctcctttcacattccagacaatggagagtgtttatggtttcaggaaaagaactttgtggctgaggggtcagttaccagtgaccttcaatcaactccatcacttcttaaatcggtatttgttaaaaaaatcagttattttatttattgagtgccgactgtagtaaagccctgaaatagataatctctgttcttctaactgatctaggatggggacgcacccaggtctgctgaactttactgttcctctgggaaaggagcagggacctctggaattcccatctgtttcactgtctccattccataaatctcttcctgtgtgagccaccacacccagcctgggtctctctacttttaacacatctctcatccctttcccaggattccttccaagtcagttacaggtggttttaacagaaagcatcagctctgcttcgtgacagtctctggagaaatcccttaggaagactatgagagtaggccacaaggacatgggcccacacatctgctttggctttgccggcaattcagggcttggggtattccatgtgacttgtataggtatatttgaggacagcatcttgctagagaaaaggtgagggttgtttttctttctctgaaacctacagtaaatgggtatgattgtagcttcctcagaaatcccttggcctccagagattaaacatggtgcaatggcacctctgtccaacctcctttctggtagattcctttctcctgcttcatataggccaaacctcagggcaagggaacatgggggtagagtggtgctggccagaaccatctgcttgagctacttggttgattcatatcctctttcctttatggagacccatttcctgatctctgagactgttgctgaactggcaacttacttgggcctgaaactggagaaggggtgacatttttttaatttcagagatgctttctgattttcctctcccaggtcactgtctcacctgcactctccaaactcaggttccgggaagcttgtgtgtctagatactgaattgagattctgttcagcaccttttagctctatactctctggctcccctcatcctcatggtcactgaattaaatgcttattgtattgagaaccaagatgggacctgaggacacaaagatgagctcaacagtctcagccctagaggaatagactcagggatttcaccaggtcggtgcagtatttgatttctggtgaggtgaccacagctgcagttagggaagggagccattgagcacagactttggaaggaaccttttttttgttgtttgtttgtttgtttgtttgtttgtttgtttgagacagggtcttgctctgtcacccaggctggggcgcaatggcacgatcttggctcactgcaacctctgcctcctgggttcaagtgattctcctgccacagcctcctgaggagctgggactacaggtgcgtgctaccacgcccagctacttctgtatttttagtagagacggggtttcactgtgttggccaggctggtctcgaactcctgacctcatgatctgcccgcctcagcctcccaaagtgctgggattacaagtgtgagccaccacacctggcctggaaggaacctcttaaaatcagtttacgtcttgtattttgttctgtgatggaggacactggagagagttgctattccagtcaatcatgtcgagtcactggactctgaaaatcctattggttcctttattttatttgagtttagagttcccttctgggtttgtattatgtctggcaaatgacctgggttatcacttttcctccagggttagatcatagatcttggaaactccttagagagcattttgctcctaccaaggatcagatactggagccccacataatagatttcatttcactctagcctacatagagctttctgttgctgtctcttgccatgcacttgtgcggtgattacacacttgacagtaccaggagacaaatgacttacagatcccccgacatgcctcttccccttggcaagctcagttgccctgatagtagcatgtttctgtttctgatgtaccttttttctcttcttctttgcatcagccaattcccagaatttccccaggcaatttgtagaggacctttttggggtcctatatgagccatgtcctcaaagcttttaaacctccttgctctcctacaatattcagtacatgaccactgtcatcctagaaggcttctgaaaagaggggcaagagccactctgcgccacaaaggttgggtccatcttctctccgaggttgtgaaagttttcaaattgtactaataggctggggccctgacttggctgtgggctttgggaggggtaagctgctttctagatctctcccagtgaggcatggaggtgtttctgaattttgtctacctcacagggatgttgtgaggcttgaaaaggtcaaaaaatgatggccccttgagctctttgtaagaaaggtagatgaaatatcggatgtaatctgaaaaaaagataaaatgtgacttcccctgctctgtgcagcagtcgggctggatgctctgtggcctttcttgggtcctcatgccaccccacagctccaggaaccttgaagccaatctgggggactttcagatgtttgacaaagaggtaccaggcaaacttcctgctacacatgccctgaatgaattgctaaatttcaaaggaaatggaccctgcttttaaggatgtacaaaagtatgtctgcatcgatgtctgtactgtaaatttctaatttatcactgtacaaagaaaaccccttgctatttaattttgtattaaaggaaaataaagttttgtttgttaaaaaaaaa

SEQ ID NO: 630 - DNA, 1310 bp, Homo sapiens
agacgccgagatgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcgcatgctgacctgtgtttcctcccca

SEQ ID NO: 631 - DNA, 320 bp, Homo sapiens
gcggggctcatgcccagtcacttcggaaacgagagcgcgcccaccaccagcaactggaactacacccacgcgctcgtcgccgacgggacgccgtattacgtctccggcgtgcggggcgtgtacaagccgtccgacacgttttcgttcacgctcgtcgcctacaacgggtggaacgccctcggaaacccgaacccgtacaagtcgggtgggtatcgcgtcgagtggcaccccagcgacacggtggccgtcgccaacgccgcgcacgtcggcatcgtcgggtctacaaggaccttcgcatcttcgaagacctggtggtcacc

SEQ ID NO: 632 - DNA, 1281 bp, Homo sapiens
cccagacctagaactacccagagcaagaccacagctggtgaacagtccaggagcagacaagatggagacaaattcctctctccccacgaacatctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggagttacaggcaaagtgaggagggagctgggggacactttcgagctcccagctccagcttcgtctcaccttgagttaggctgagcacaggcatttcctgcttattttaggattacccactcatcagaaaaaaaaaaaaaagcctttgtgtcccctgatttggggagaataaacagatatgagttt

SEQ ID NO: 633 - DNA, 2298 bp, Homo sapiens
cgagcggttctcacccgccctctccgcacgtccgccggcgcctcaggtttcccccggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacggagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgccaaaaaaaaaaaaaaa

SEQ ID NO: 634 - DNA, 359 bp, Homo sapiens
tttttttttttttttttttttttttttttttttttttttttaaaacaaaaagggctttattaaaacccccaaaaaaaacttttaacaaaaggggacccataccattccccaaaaaagtttagctgaaaaatggcaaacaaaaagggcaaggctttttttaaacccccaaaaataaggttccacaaaaaaggacccgccaaaaccaaattatagcggcaaattttttttggccataaatagggatccccttaaaaatccttggaaactccttggcagttttaaggcccaaactaacccttgtgggccagtggctcaccttcatcaaaaaaaggaacccatttggcaaaaaaattttggtt

SEQ ID NO: 635 - DNA, 240 bp, Homo sapiens
cgtcttcgacaagaccggcaccctcaccaagggggagcccgaggtcacggacgtcattgtcggcgacttcgatcgcgatcgggtcctggcgctcgcgggcgcactcgaacgagagtccgaacatcctctcgctcaggccgtcgtgcgccacgtcgatgcaaccgatgtgccgcgcttgcgcgccaccgcgttccgcaacgtcacgggcatcggcgccctcgccgaggtcgacggccacca

SEQ ID NO: 636 - DNA, 498 bp, Homo sapiens
  misc_feature (384)..(489): n is a, c, g, t or u
tgcccttcccttcgctggagagccccctttccccctttcctgcctcttccccatggccccgagcatcttccagcagaccccagtgtatgactccttcctacctccccaaagaatggggagagggaacgagcagagcctgtgcctgagccatctcgttcaacgccttcaacgcggggcttggagtcctggcttggcactcccttgctggtgatcttgggcaaaccatgctgggcctcgattttcctactggcaccagagagagcaggacgacttcttcaaattcttgtgcaaatacggcgagaagaagtgcatgagaaagtgctttataagctgtatagctctcttgcctatgagagtatcattgtagttcatctcacataaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaggaaa

SEQ ID NO: 637 - DNA, 443 bp, Homo sapiens
tttttttttggaagagatctttattaatagagtgcttttattaataattcataccttgtctaagcggtaaaaacccagcagaggattaacccatgcccatggtatttgaaactataaagaataaagttttctcctgtatttgttaggaattgctcttggctgcaagtaacagagaactgaaataacagtcatttaacacaagacacaaatttctttctgtctcatgtaaaagaaacccaagcagcagtcctgggcccccaagtatcatcagtgactgtggctccttctttctttctgatctgccatcctccaagtggggtttccaccctcacagtcacctcaagatgcaagaacactgctggtgctccagccattgcgtctgcatccgcagcagaaaactggaggaagcgccatttgtctctcccccaaacttccccttacat

SEQ ID NO: 638 - DNA, 450 bp, Homo sapiens
caccttgagagagcactttgcagatgactctaatgaacaatccttgaacaaagaattttaaaagatttaatctagttcataacacagctttatagctatagataagtcatttaagccttctgagccttatcagtcaaagaggaatgttaatatgtaataggaaatgaagaattggtgaaaatactttgtgaaagaaacataactttaagatagtactatatctgaatcccttgctgttccctatatggtgccttacacatcataagccagcaaataccttggtctgattgaatggtaatgggatatattttattaaaatcaaagttttgctagggctgggaagctctaccaaaagaagaaaaaattatctttcttggtcatgtttccctctttactccacgacagtttcattattgtaaccagggatcaatgaaagaagaaagcagggtt

SEQ ID NO: 639 - DNA, 1048 bp, Homo sapiens
gccaggtgtgcaggccgctccaagcccagcctgccccgctgccgccaccatgacgctcctccccggcctcctgtttctgacctggctgcacacatgcctggcccaccatgacccctccctcagggggcacccccacagtcacggtaccccacactgctactcggctgaggaactgcccctcggccaggcccccccacacctgctggctcgaggtgccaagtgggggcaggctttgcctgtagccctggtgtccagcctggaggcagcaagccacagggggaggcacgagaggccctcagctacgacccagtgcccggtgctgcggccggaggaggtgttggaggcagacacccaccagcgctccatctcaccctggagataccgtgtggacacggatgaggaccgctatccacagaagctggccttcgccgagtgcctgtgcagaggctgtatcgatgcacggacgggccgcgagacagctgcgctcaactccgtgcggctgctccagagcctgctggtgctgcgccgccggccctgctcccgcgacggctcggggctccccacacctggggcctttgccttccacaccgagttcatccacgtccccgtcggctgcacctgcgtgctgccccgttcagtgtgaccgccgaggccgtggggcccctagactggacacgtgtgctccccagagggcaccccctatttatgtgtatttattgttatttatatgcctcccccaacactacccttggggtctgggcattccccgtgtctggaggacagccccccactgttctcctcatctccagcctcagtagttgggggtagaaggagctcagcacctcttccagcccttaaagctgcagaaaaggtgtcacacggctgcctgtaccttggctccctgtcctgctcccggcttcccttaccctatcactggcctcaggcccccgcaggctgcctcttcccaacctccttggaagtacccctgtttcttaaacaattatttaagtgtacgtgtattattaaactgatgaacacatccccaaaa

SEQ ID NO: 640 - DNA, 633 bp, Homo sapiens
ttttttttttttttttttacataactagaataaaatttaatgtaaatgtgccaaagaggagaagaaatcacatgagatttacaaaacttacatgaaataagaaaatgttcagctatgtaataaccaaagcttccttaacttgggaatcttgggaacctagaaagtgaggtaacccaagccaaattcctctggtgtcacagttcctcctataccaggccaggcacttgccaatgacactggagtaggggtaagccctgggtgtgttgtgtagtgtgtgacgtagtaggtgaaaaacagcaaagaggtaattctttattctcgagagcttcctcgtgcacatgatcagcttttgcacatgcttgaaggaaaaacaacactattaaaatgtctttttaaaagtcaaagctaaatgagtatgcaataaagctttgagaaatggaaaagaaaatctatgaggaaaacgtcagcttgcttatccagggaatgagcaggacttaattctcatgccggcatggggctgccgggcacccagctcctttcctgtgggtagaaaacaagtccccaagttgctactgagccaaactgtaaaggccagtcaggaaatgagcagcagtgctgaatgggcctcgtgcc

SEQ ID NO: 641 - DNA, 306 bp, Homo sapiens
gacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatg

SEQ ID NO: 642 - DNA, 2311 bp, Homo sapiens
tagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaaggaaaaaaaaaaaaaaaa

SEQ ID NO: 643 - DNA, 329 bp, Homo sapiens
ttcttgggatgaggtccaaatttactaataaggcctgaaaccctgtgtaattttgctcctagttatggctggcatctgcaccacaactacagccactgccacctccccctgccacacacacattttaaaagtaacaatagtagtgttttctgtgttttgcatatacagtcttttctcatctcccagccttcttgagcttttcctctgcctgagatacgctcccactcacatagacattgggggcactaaataaaaatagctgtttaattgaattggaatcgttccacttggaacccaagtttggaaattttgctacttcttgttaagct

SEQ ID NO: 644 - DNA, 373 bp, Homo sapiens
ttttttttttttctgtttatattataatctttattgcatctgatggtcctgtctcatttttgctgtctcatcagtaaaccattgcaaaccacagtgccagcccttgtgtccccacatttttgacacaataatttcctccaggtgtggctgagtcagaattccgtccgcgtccatccctgtgcgtcctgtatgggtgacagtgcaagggtaagaacagtgggtgtattcagtggggaaataacatgtgtgctgtgaaagaaaatgagaaaaacacagcgtctccattaaaaaactgtatgtcctcgagtccacaaaagagttggaaaaaaaccactcgggccatctgggcatctgttcagatgaacgatcttgt

SEQ ID NO: 645 - DNA, 351 bp, Homo sapiens
cacagtcacacctcagggtgagccagctctgcaataggatgcactgctttgtctgcagcctcacagacctgaaatgcactctcatgtcctgtgcctcagtgctggctgggccttggtcctattacatcttgaactcaaggtaatacatcagtggccgggattcacactcagaaccaccttgaaagtctgtgctgttaccaccatgtcacagaggtagaagtagatgtctgtataaacaacctttgggtagcaggtggtcagttaggcaggaaaaatagttctgctacattatatatatcaggagtatattgacaggaacatgtgtgttgggaatatatatgtcagtaacag

SEQ ID NO: 646 - DNA, 4692 bp, Homo sapiens
agaatggaagagctcctgtccggtgtgccagcagcccggactggcggtgagcgcgagggaggctactgagaagcccggcgacggaggaacgcaggtctgctgccagggattgaggagactgaagaacgctgaagacaggctgatgggctcagctggtaggctccactatctcgccatgactgctgaaaatcccactcctggagacctggctccggcccccctcatcacttgcaaactctgcctgtgtgagcagtctctggacaagatgaccacactccaggaatgccagtgcatcttttgcacagcttgcctgaaacagtacatgcagctggcaatccgagaaggatgtgggtctcccatcacttgccctgacatggtgtgcctaaaccacgggaccctgcaggaagctgagattgcctgtttggtacctgtggaccagtttcaactttatcagaggttaaaatttgaaagagaagttcatctggacccctaccgaacatggtgtcctgttgcagactgtcagacagtgtgccctgttgcctcgagtgacccaggacagcctgtgctggtggaatgcccttcttgccacctgaaattctgctcgtgttgcaaggatgcttggcatgcagaggtctcctgtagagacagtcagcctattgtcctgccaacagagcaccgagccctctttgggacagatgcagaagcccccattaagcagtgcccagtttgccgggtttatatcgaacgcaatgaaggctgcgctcagatgatgtgcaaaaactgcaagcatacattttgctggtactgcctccagaacttggataatgacattttcctcagacattatgacaaagggccatgcaggaataaacttggccactcaagagcatcagtgatgtggaaccgaacacaggtggtggggattcccgtaggcttgggcatcattgccttggttacttcacccttgttactcctggcctccccatgtataatctgttgtgtctgcaagtcctgtcggggcaagaagaaaaagcacgacccatccacaacctaaagatctctgtgttcatacgccccagatatgtgagttacatgagatggcacagtgataaagccccatttagtgaccttgcctccttctccttgccaactttgaaagtgcctccgtgtccagactttgaacttgcctgccagccttcagcatcaggaaaggccaagtcctgggtgtgagtgttcctgtgtaacaagaactgggctcaacggtccagctgtttctatggagctttggggttccttgagatgaatgaacatatcattttatcatccaaaggatctcactggactgttcaacttccagccaaattcaaggagcttgcgggaacatttgatataacaaatgtgttgtcattgttggcaacatacaagataaccaagaagctggagtctgttctgtgttgatttgactaccatgagaaacacaggggaaacctgatgaggagaaggataagactgcgtaaggagaaatcctcataggagctataaagcaggctgctgatctcagcagttgatatggtggttgtgcctctgctggctactgggtgtgctgtccccatgttcccgctgtgatttggcagaaacacaataggcttctccttgtgtgatctcagcttcaagcaggtgaaactgctgtgcagagggagttgccccttcccagtaaaagagttgcagcctgttaaacaatgtggtctaatttagtgtctctcccttggcaaatgtaagttttctaagttggccaacttgtctcttacagccagtggctgtggtctacagaattgtttcatataaaatacgggtagagtggtagagtttcaaaactttcgtcatagatatctgggacctttctcaggatctgtgttcgcacagccaatagatttggaatcaggcctaagagtacacatggagggtaaatattaaagtgcgtattatgtacatctagaatccatgtgacttgcagcctacctgtaatttctatccattgagcatgcatggatatacccaatagtacacacaaaataaatgtttacttaagagccattctatccttttgtgactgaaatggtttattgtaaatctgcctaaagattttttgcatattatatatgtgaattttggttgtaagttcataacttacccaagggtatagactcataactcttttaaaacagtgcttagtacaatatcctgccatctctgtaaaaacgctaattgataaccgagtcatttacatgttttcgaacacagaatagctcttttctcagcatcattattgctctttcagcatctgttaggacagtctgaatactttctgtttcaaggcactgataaaaccgcaacaaaaacatgtaagaaataaaatagaagtgctttatatattttagtttaaatttatgtatcacctcattgtgacttattttttccattataccattagtcagatttgaataacgaggttttgaaaggataaaaccttttctccaatgacaggattatataattgctattggcaatgtagcctggtgcttcatgagacctatgctaaatgttactggagagttcttgaagccagggataccatatcaggaactattcaggatctatgatattttctgaggtaactgggtaatagaatatcaaattgctgctatctcggacctattgttaaaggacgatgctttgcctatgtaataggatatatcctaagtggggatgtgtatatttcaggaactttaattcacaagtatatattgatatctgatgtgtgtatagtacatctgttggttatgtacattttaatttacatgttgtgtagaacatagatgagaactctgggaaaacttgggaatggcaaccaaccaaaatcatttttaatcatttattagaaatttctcaatattgtgtctttttcttttgaaactctaaacacttcagaaaaaaacactatcagtgtagttcatgttagtataattatagatttacatatatttgaatagttaatttgctttgttttacacgtagcccactgcctcattataggtaaaaggcatttataactgctcaggggattacgagaactcaactgaaactgaatttttgtaacaagaatgttaatagtggcaaagtcctctgtcagtaaactctttaagcttggtgccgcaaagagtctttaaatgggggctgatttcaagtaacctaaaagactgtgttatcagaggaagaggtcccaaatttggagtaaagatgggagaaaataaatatgtgctatttccttggcgagttgggtgaatttgccaccttacagagtttgtatcactgaattagctgcttttgtttttttttttttttttttttgccagggctatggagtgggggttgtttgtcaaactgattttcaataattggatttaattttttttaacattgaaaagtgcctgaaaaatggtaaattcttaaatgtgtgtgagattgtcagaatcaacaaaactaggttggttaaacatatctctggtacatcaaggggcatgatacaaaccagtctaaagactgtttataaaggagagagctggcgacttatttttattttttttttttggacagagtctccctttgtcacccaggccggagtgcagtggcatgatcatggttcacttcaacccctacctcctgggctcaagtgttcctctcaccttatcctcctgagcagctgggactacaggcacacaccaccacacctggctaagttttgtattttttgtagagatggggtttctctgtgttgcccagtcttgtctcaaactcctgggctcaagcgatctacccaccttgggctcccaaagtgtcgggattacaggtgtgtgtcactgtgcctgacagctgacagttttaactgacaactttgataacagaggctgctatttttgttttagataattggccagtgacagagtttacccttgcctcctttcttggtctgccagctttgtcctttctgagtgattctctttctgtattgagaggaagtgtgggtctacatagggatgtttggatgctatggcaagaatctttttgtgtttggagtgtagtccatttgcaatagaaataaaaaaatccgtcaccaaattgtaacctggatgttatagcccagcatctagaaatcctatgaaatgtattagcacaatatcttgccattgtcccatctaggaaattttttcttgttgtgaggtagggaagtgaggaggaaagccatgccgaagcaaatgttagaatcttaggcatcctatttgttcatgccatgggtatttgctttggacttggagtctgtactttgaaagaggcctttgaaaaacaaataattctgtgtgaattttcttgtagcgtgcttcatgaaaatatctacttatccaggtttgcaaatgtacatgttcatttgaatgtaaatcaccatttcttggaaccccacgttttttcttaaaaattattctgaattaaatgtatatttctttagccttccctacacagtactaataaaagacttttctttctgttcaaaaaaaaaaaaaaaaaaaaaaaaaaaaaaaaaaaaaaaaaaaaaaaaaaaaaaaaaaaaaaaaaaaaagaaaaaaaaaaaaaaaaaaa

SEQ ID NO: 647 - DNA, 1991 bp, Homo sapiens
cttgctccgagagggagtcctcgcggacgtcagccaagattccagaatgactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatagtttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattggaaaaaaaaa

SEQ ID NO: 648 - DNA, 2811 bp, Homo sapiens
acacaggaagctgagccggcttggggcccagcatacacaggcccccaggacccctggggagagggccccgctgggctggccctgcagggaccatggaatccagagctgaagggggctcccctgctgtgtttgattggttcttcgaagcggcctgccctgcctccctgcaggaggatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcctgccatccatccctgagaacaggaacctaacggagctggtggtggccgtgactgacgagaacatcgtggggctgttcgcggcgctcctggccgagagaagagtcctgctcaccgccagcaaactcagcaccctgacctcgtgcgtccacgcgtcctgcgcgctcctgtaccccatgcgctgggagcacgtgctgatccccacgctgcccccacacctgctggactactgctgcgcgcccatgccctacctcattggagtgcacgccagtctcgccgagagagtacgagaaaaagccctggaggacgtcgtggtgctgaacgtggacgccaataccttggagacgacctttaacgacgtgcaggcgctgcctccagacgtggtgtccctgctgaggctccggctcaggaaggtcgccctggcccccggggaaggggtgtcccgtctcttcctcaaagcccaggccctgctcttcggggggtaccgcgacgcactcgtctgcagcccgggccagccagtgaccttcagtgaggaagtcttcttggcccagaagcctggggcacctctgcaggccttccaccggcgggctgtgcacctgcagctgttcaaacagttcatcgaagcccggctggagaagctcaacaagggggagggcttctcagatcaattcgagcaggagatcactggctgcggggcctccccaggggcccttcgatcctatcagctctgggccgacaatctaaagaaaggtggtggcgccctcctgcactcagtcaaggccaagacccaaccagccgtcaagaacatgtaccgctcggccaagagtggcttgaagggggtgcagagccttctaatgtataaggatggggactctgtcctgcagagggggggctctctgagggccccagccctccccagccgctcagaccgcctgcagcaacgcctcccaatcactcagcactttggaaagaaccggccccttcgccccagcaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacatactaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattttacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcaagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttactctcaaaaaaaaaaaaaaaaa

SEQ ID NO: 649 - DNA, 2315 bp, Homo sapiens
ttttttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcat

SEQ ID NO: 650 - DNA, 636 bp, Homo sapiens
ggcaacaccctgtgataattccaggtgattctctacatctgcagcttgaggtgggaagtctgaagctcagagagcctgggccaatggtacaggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttggcagaataaataacttctttaaacaattttacggcatgaagaaatctggaccagtttattaaatgggatttctgccacaaaccttggaagaatcacatcatcttagcccaaggtgaaaactgtgttgcgtaacaaagaacatgactgcgctccacacatacatcattgcccggcgaggcgggacacaagtcaacgacggaacacttgagacaggcctacaactgtgcacggttcaaaagcaggtttaagccatacttgctgcagtgagactacatttctgtctaaagaagatgtccctgacttgatctgtttttcaactccagttcccagatgtgcgtgttgtggtcccc

SEQ ID NO: 651 - DNA, 886 bp, Homo sapiens
gtcggttccgggcgttaccatcgtccgtgcgcaccgcccggcgtccaggtgagtctcccatctgcagagacgcggacgcgccggcccgcagttggcctgcggagcgcggtggacggtttggcgcccaccaggcgatcaatactttggatttttaatttctagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaagatttctcaaagattaggtatatatttaaatggaagagaaaatatttttatgggagaaaaatacatttgaaccatgaaatttcatcttttaaataacatccagtacagatatctgtgtaaaaaaaaaaaaaa

SEQ ID NO: 652 - DNA, 7686 bp, Homo sapiens
tttatagcagcagcagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatcaaactgtagcagaaggttctccatttccctcggagtcgaccctggagtcaactgcagcagaaggttctccgatttccttggagtcaaccctggagtcaactgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacacgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccatgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccatgtcagccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaaccgggctgtggctgggccatgtcagccccaggaaatgcccggtttggtcagggctcaggacccattgtcctggatgatgtgcgctgctcaggacacgagtcttacccgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccgtctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggcgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 653 - DNA, 506 bp, Homo sapiens
ctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgcc

SEQ ID NO: 654 - DNA, 2952 bp, Homo sapiens
ggcgcggtcgagtcatcgcagggcctcaccgcttcgttctcccgtccctccccgcgccttggctcgactagccaagtgaggcgggaggcgactcggacctttccctgcatttcgtttcggccagtgccggggctacccgccctggggcctgggatccttggggcccgtgagccactcttagcggccggggctaccgcggcccgccgtggccctcatgaggcatagctgaccaagctgctggcagcctcgggcagcaactccccaacccgcagtgagagcccggagccggctgcaacttgttcgctgccctctgacctgacccgggctgcagcgggggaggaggagacggcggcggcgatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccagtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctgtggatacagctgttggggcagaagagacgggaccagctgctggccacatttcctgctttattttaaaaggtagtataagaatgaggaaaaagaggtaatatcagggcttctgctgttttttatttttaacatgttcataattaaaaagtattttccagcagtccaaagatgtaagttatcttacacataatatgttttattttgttatttggttatgaaaatggaatccttgttcttgcacaactgtaaatgttttgttgctagataatacgatttgagacctgaattggtctttggtttccagtgcatcacagcatattttgtaaaatcatgtactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaactttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggccgtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtg

SEQ ID NO: 655 - DNA, 2618 bp, Homo sapiens
atgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaattaacttttcccttttatacaga

SEQ ID NO: 656 - DNA, 2128 bp, Homo sapiens
gggccggcaggggcggtgcgcgggaagggaccccggacccggaggtcgcggagagctgggcagtgttggccgctggcggagcgctggggcagcatgaagtgcctggtcacgggcggcaacgtgaaggtgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggccggagcagccgcctggtggtccagctgcattgcaagttcggggtgcggaagactcacaacctgtccttccaggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagctaccacgaggaggaggcagacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaatacaaaaaaa

SEQ ID NO: 657 - DNA, 500 bp, Homo sapiens
tttccaattcacttcaattttttatttcagcaagcagcagtgggcctgtgaagttttcaaagtgccccaggcatttctttctggactcaatatattaagtcaaagaaagtagcaggtcttaggtgccaatgaagtggcattaagctatttctctttgcaaggcctccttctctgtgaagcaaatcccagccactcactcacttaaagcaatgcagaacgtctggtcagcaaacagaaaaaggataaaaattcctcagttcctcacctgtattattaccattccctcccccagggaaaggcaggctagtagaaattctacagaggtcagtaaacataggtggttatttgcaaaagtagttagtacttttctcaggctataaaagcaatggcatttgggggtcacaatgctaaccatacactgccccctctgatgacttttattccttgaggttcgctcattggatgccccactctatagccagatcgcatcacacagcctc

SEQ ID NO: 658 - DNA, 5458 bp, Homo sapiens
gccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccaaaaaaaaaaa

SEQ ID NO: 659 - DNA, 1373 bp, Homo sapiens
  misc_feature (241)..(241): n is a, c, g, t or u
ctttttttttttcgtctgggctgccaacatgccatccagactgaggaagacccggaaacttaggggccacgtgagccacggccacggcgcataggcaagcaccggaagcaccccggcggccgcggtaatgctggtggtctgcatcaccaccggatcaacttcgacaaataccacccaggctacttggggaaagtgggtatgaagcattaccacttaaagaggaaccagagcttctgcccanatgtcaaccttgacaaatgtgtgggacttgggtcagtgaacagacacgggtgaatgctgctaaaaacaagactggggctgctcccatcattgatgtggtgcgatcgggctactataaagttctgggaaagggaaagctcccaaagcagcctgtcatcgtgaaggccaaattcttcagcagaagagctgaggagaagattacgagtgtggggggggcctgtgtcctggtggcttgaagccacatggagggagttcataaatggtataccaaaaaaaaagaaaaaaaaaaaattgtttggggcggggcccagaaaattcaaaccacggtgcgggcgggccagagatggcaacgggccgagggcgcagagaccgggacgacaggggggttccacaaaaaagcgcgggccgggtgaagaacagggtccgccagggtcgcaggcacggatcatcccccgccgcggcccacacacgacgacacagacaaacgaagagacaagacccatctgatgtcctcagtctcaggcgacgacgtgccaggagaggcgcgcagaaacactgcaaaaaactgacaccgcagcaggcccagccacccacaaggcaaaagtgccaccgacgcgcgcaaccggagcgccaaagccgagccaagacgagaagaaccgacacgagcagcacaagggcggcgacgcggaaggagacaggagccacggcagacggaccagacacgatgcaacacacgcaaagacgcacccaagacagaacggacagacacaaacaaggagaaagcaggagaactaccgaccgcgacgcaagagacacagaaaacagaggggaacgaggcagagaaaagagaacgagcgcgaacgcgacggatcaaggcgagcagaccagacacagaacagcggggacacagcagaagaacgaagaacaacagagacgcgacagaaagacaaagaaccgcagagcagacaccaggccaagagcaagaggggagaacacacagcgagggaacgagcgagagagagatgagaaatacagacatgaaggaagacgagcaaggacacagcgagagtccaggaacaggcagacaagcgagaaagaggagaagcgcaacacgaacagaaaaccagagcgag

SEQ ID NO: 660 - DNA, 690 bp, Homo sapiens
tgcacaagcagaatcttcagaacaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttt

SEQ ID NO: 661 - DNA, 1189 bp, Homo sapiens
gcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaaaaaaaaaaaaaaaa

SEQ ID NO: 662 - DNA, 1890 bp, Homo sapiens
cccgcgagcggacgcggcagcgcctctgtctcgctttttcttatttttcccccctttcccctttctttttttttttttcttttcttttctcccctccccccctttcaccatttcccctcggaggcgctttccccgggcaggggcagagccggtctcaccccccgcctctccccggcccccgccgccctatggcgagagggagccccctcccaacccgggctcgagcggcggcggcctcaggccgggggtcatcatggaactaattcgctgaccgacccagcggccgcagccgtgcgtcccgctcgagcgccagcgcccgcgcccgcgccccccgatccgcttcccctttctccctcctcagttggccgagtcgtcccgcgcgcaccgcctccgcgcgcctatgagaatgaggtggtaacgggcccccggatgaccccgcgtcaccactgtgaggcctacagctctgccggggaggaggaggaggaggaagaggaggagaaggtagctacagcaagctgggtagcaggcagatccaaaggatatcatgaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgtaaaggctcatccaaaatacttgagttgtattgcaatcagctgttttttcctagctgccaagactgttgaggaagatgagagaattccagtactaaaggtattggcaagagacagtttctgtggatgttcctcatctgaaattttgagaatggagagaattattctggataagttgaattgggatcttcacacagccacaccattggattttcttcatattttccatgccattgcagtgtcaactaggcctcagttacttttcagtttgcccaaattgagcccatctcaacatttggcagtccttaccaagcaactacttcactgtatggcctgcaaccaacttctgcaattcagaggatccatgcttgctctggccatggttagtctggaaatggagaaactcattcctgattggctttctcttacaattgaactgcttcagaaagcacagatggatagctcccagttgatccattgtcgggagcttgtggcacatcacctttctactctgcagtcttccctgcctctgaattccgtttatgtctaccgtcccctcaagcacaccctggtgacctgtgacaaaggagtgttcagattacatccctcctctgtcccaggcccagacttctccaaggacaacagcaagccagaagtgccagtcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagaaaaaaaaaataaaactctcattatttgtgtggctaattataattcagcgttatttaagcacataaagaccaaaaaaaaaaaaaaaaaaa

SEQ ID NO: 663 - DNA, 4050 bp, Homo sapiens
cttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcacggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcatctagctgtctgctcagacagaacccctacatgaaacagaaacaaaaacactaaaaataaaaatggccatttgctttttcaccagatttgctaatttatcctgaaatttcagattcccagagcaaaataattttaaacaaagggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtg

SEQ ID NO: 664 - DNA, 1258 bp, Homo sapiens
ccgggctctacccagagcaagaccctgatggctgcggtgtttctggtaacgctttatgaatactcgccgcttttctacatcgcggtggtctttacctgcttcatcgtgaccaccggcctggtattgggatggtttggttgggatgttccagtaattctgagaaattcagaagagacccagttcagcacaagagttttcaaaaagcaaatgagacaagtcaagaatccttttggcttagagatcactaatccatcttcagcttcaattacaactggcataaccttgacaacagattgccttgaagatagcctccttacatgctactgggggtgcagtgttcaaaaattatatgaagctctgcagaagcatgtttattgcttcagaataagcactccccaagcattagaagatgctctgtatagtgaatatctctatcaggaacagtattttattaaaaaggatagcaaagaagaaatatattgccagttaccaagagatactaaaattgaagactttggtacagtacccagatctcgctatccattggtagcgctattgaccttagctgatgaggatgaccgggaaatttatgatattatttccatggtgtcagtgattcatattcctgataggacttataaactatcctgcagaatattgtatcaatatttactcttggctcaaggtcaatttcatgatcttaagcaacttttcatgtctgcaaataataatttcactccctccaacaattcctcttcagaagaaaaaaacacagacagaagtttgttggaaaaggtgggactctctgaaagtgaagttgagccatcggaagagaacagcaaggactgtgttgtttgccagaatgggactgtgaactgggtactcttaccatgcagacacacatgcctgtgtgatggctgtgtgaagtattttcagcagtgcccaatgtgcaggcagtttgttcaggaatcttttgcactttgcagtcaaaaagagcaagataaagacaaaccgaagactctttgaagacatcgtaacactgaaaagtacactttctactaaagatgcagaaattgatgatcttggaattcatcataacatggaatctacagtactgaccatcaatgaaaattatattttaacttcatatttgtatggtacttggatgataaaaattaattattcctttctgcttagtgaatgaatactggaatccatctgtgttgatacaataaaaattcattcaactcttgaaaag

SEQ ID NO: 665 - DNA, 21 bp, Homo sapiens
gtaacccgttgaaccccattc

SEQ ID NO: 666 - DNA, 20 bp, Homo sapiens
cacaatgtggccgaggactt

SEQ ID NO: 667 - DNA, 20 bp, Homo sapiens
caccgatctcaggggttctg

SEQ ID NO: 668 - DNA, 23 bp, Homo sapiens
tccaacatcaacatcttggtcag

SEQ ID NO: 669 - DNA, 21 bp, Homo sapiens
ccaaaagacaccagccactca

SEQ ID NO: 670 - DNA, 20 bp, Homo sapiens
ccctccctccatcgttttct

SEQ ID NO: 671 - DNA, 21 bp, Homo sapiens
tggggtcaagactgacaatcc

SEQ ID NO: 672 - DNA, 23 bp, Homo sapiens
gaggaaaaagcgagagaaaagga

SEQ ID NO: 673 - DNA, 20 bp, Homo sapiens
cccctccaggatgtgtctgt

SEQ ID NO: 674 - DNA, 20 bp, Homo sapiens
caagagcctgatgcccaact

SEQ ID NO: 675 - DNA, 20 bp, Homo sapiens
cctactgctttgccccaaga

SEQ ID NO: 676 - DNA, 20 bp, Homo sapiens
gacctcccctggtgaagaca

SEQ ID NO: 677 - DNA, 20 bp, Homo sapiens
caacaggacgccctctgatt

SEQ ID NO: 678 - DNA, 20 bp, Homo sapiens
ctgtcagcaggaagcaacga

SEQ ID NO: 679 - DNA, 20 bp, Homo sapiens
caaagggttgggagctgatg

SEQ ID NO: 680 - DNA, 21 bp, Homo sapiens
agtttgctggcctgtacttcg

SEQ ID NO: 681 - DNA, 20 bp, Homo sapiens
ccaaccacaagcacacagga

SEQ ID NO: 682 - DNA, 20 bp, Homo sapiens
tccacattccaaaagccaca

SEQ ID NO: 683 - DNA, 20 bp, Homo sapiens
gccacctcctgctgtttctc

SEQ ID NO: 684 - DNA, 20 bp, Homo sapiens
cccctgtcccctctatgacc

SEQ ID NO: 685 - DNA, 20 bp, Homo sapiens
ggaccaggtcttggagctga

SEQ ID NO: 686 - DNA, 20 bp, Homo sapiens
ctgccctgtaggaaggcaga

SEQ ID NO: 687 - DNA, 20 bp, Homo sapiens
ttcctggttcgggtgttacg

SEQ ID NO: 688 - DNA, 20 bp, Homo sapiens
ggcaatcccaggaagacaaa

SEQ ID NO: 689 - DNA, 25 bp, Homo sapiens
tcaggtatgttgcctttatggtttc

SEQ ID NO: 690 - DNA, 20 bp, Homo sapiens
tgctgtaccacccacattgc

SEQ ID NO: 691 - DNA, 20 bp, Homo sapiens
cacatccagctccttcagca

SEQ ID NO: 692 - DNA, 20 bp, Homo sapiens
cctaccccaccccacctaaa

SEQ ID NO: 693 - DNA, 20 bp, Homo sapiens
gactgggatggcctcaagtg

SEQ ID NO: 694 - DNA, 20 bp, Homo sapiens
ggcaggtactcagtgcacca

SEQ ID NO: 695 - DNA, 20 bp, Homo sapiens
ggagagggccattccaatct

SEQ ID NO: 696 - DNA, 20 bp, Homo sapiens
cacctgcgtgatgaggagaa

SEQ ID NO: 697 - DNA, 20 bp, Homo sapiens
ctggaagccctttgttgtgc

SEQ ID NO: 698 - DNA, 20 bp, Homo sapiens
ctcctgccgacaagaccaac

SEQ ID NO: 699 - DNA, 20 bp, Homo sapiens
tacttcccgcacttcgacct

SEQ ID NO: 700 - DNA, 21 bp, Homo sapiens
aggcagaatccagatgctcaa

SEQ ID NO: 701 - DNA, 20 bp, Homo sapiens
ggcagaagccatacccttga

SEQ ID NO: 702 - DNA, 20 bp, Homo sapiens
gtggaagaggctggaggtga

SEQ ID NO: 703 - DNA, 20 bp, Homo sapiens
cagctttggcaacctgtcct

SEQ ID NO: 704 - DNA, 20 bp, Homo sapiens
gcactaccccggagacttca

SEQ ID NO: 705 - DNA, 20 bp, Homo sapiens
tatgactgcagggtggagca

SEQ ID NO: 706 - DNA, 20 bp, Homo sapiens
agtgaccatctccccatcca

SEQ ID NO: 707 - DNA, 20 bp, Homo sapiens
tacacctgccaagtggagca

SEQ ID NO: 708 - DNA, 20 bp, Homo sapiens
ctgtgtgtggggtggggtat

SEQ ID NO: 709 - DNA, 20 bp, Homo sapiens
gaccaaggaaatcggcctct

SEQ ID NO: 710 - DNA, 20 bp, Homo sapiens
cacgcgacatccaatccata

SEQ ID NO: 711 - DNA, 21 bp, Homo sapiens
ggctgtgttccaacaaccatt

SEQ ID NO: 712 - DNA, 20 bp, Homo sapiens
gtaggtgacggcagcgtagc

SEQ ID NO: 713 - DNA, 20 bp, Homo sapiens
cctcgctttcaagaggcaga

SEQ ID NO: 714 - DNA, 20 bp, Homo sapiens
gcgtgtgtacacgggactga

SEQ ID NO: 715 - DNA, 20 bp, Homo sapiens
ctgaagagtacgcgctgcaa

SEQ ID NO: 716 - DNA, 20 bp, Homo sapiens
gtgttgggagggcagaagtg

SEQ ID NO: 717 - DNA, 20 bp, Homo sapiens
tgaagaccacctcccaggtc

SEQ ID NO: 718 - DNA, 20 bp, Homo sapiens
ccgtgtgtctcgtctcctga

SEQ ID NO: 719 - DNA, 21 bp, Homo sapiens
tcaaagcagcagagagggaac

SEQ ID NO: 720 - DNA, 21 bp, Homo sapiens
ggttgagagtgtgggtcttgc

SEQ ID NO: 721 - DNA, 26 bp, Homo sapiens
gccaataaagaaattaacacccaaaa

SEQ ID NO: 722 - DNA, 20 bp, Homo sapiens
tggagcagaggggctgaata

SEQ ID NO: 723 - DNA, 20 bp, Homo sapiens
atcctgctggccctgtacct

SEQ ID NO: 724 - DNA, 22 bp, Homo sapiens
cctcagccatctttgtgagtcc

SEQ ID NO: 725 - DNA, 20 bp, Homo sapiens
ggcgatgtggacaatgatga

SEQ ID NO: 726 - DNA, 20 bp, Homo sapiens
gccgcgtcacttctctgatt

SEQ ID NO: 727 - DNA, 22 bp, Homo sapiens
agtgggaccttgactggagaaa

SEQ ID NO: 728 - DNA, 20 bp, Homo sapiens
tcatcttggagggaccaagg

SEQ ID NO: 729 - DNA, 20 bp, Homo sapiens
atgtgggagggagcagacag

SEQ ID NO: 730 - DNA, 20 bp, Homo sapiens
ggagggactgcgtggtattg

SEQ ID NO: 731 - DNA, 21 bp, Homo sapiens
gggataggtggagggatgaag

SEQ ID NO: 732 - DNA, 21 bp, Homo sapiens
tcaaacaactgtggccagtga

SEQ ID NO: 733 - DNA, 20 bp, Homo sapiens
accctgagcaactgggttca

SEQ ID NO: 734 - DNA, 20 bp, Homo sapiens
cccgtgtgtttccggtagtg

SEQ ID NO: 735 - DNA, 20 bp, Homo sapiens
ctggtactggccctctgtgg

SEQ ID NO: 736 - DNA, 20 bp, Homo sapiens
accaacagagtggggtttgg

SEQ ID NO: 737 - DNA, 20 bp, Homo sapiens
cggcagattttcaagctcca

SEQ ID NO: 738 - DNA, 20 bp, Homo sapiens
gcaatgccagctgaatagca

SEQ ID NO: 739 - DNA, 24 bp, Homo sapiens
tgatactcccagtcttgtcattgc

SEQ ID NO: 740 - DNA, 20 bp, Homo sapiens
acgagcctgcaccaaagtct

SEQ ID NO: 741 - DNA, 23 bp, Homo sapiens
ctacctcaagggggactgtcttt

SEQ ID NO: 742 - DNA, 19 bp, Homo sapiens
gcacgggctacaagctgag

SEQ ID NO: 743 - DNA, 21 bp, Homo sapiens
agcaccgtgtgggacaataac

SEQ ID NO: 744 - DNA, 20 bp, Homo sapiens
gactgtgctccggcagttct

SEQ ID NO: 745 - DNA, 20 bp, Homo sapiens
ctgaggcagacagcagctca

SEQ ID NO: 746 - DNA, 20 bp, Homo sapiens
ttcgatgggcccaattctta

SEQ ID NO: 747 - DNA, 20 bp, Homo sapiens
aattgttggagagcccctca

SEQ ID NO: 748 - DNA, 24 bp, Homo sapiens
agtgattgacttggcatgaaaatg

SEQ ID NO: 749 - DNA, 22 bp, Homo sapiens
ctggtgggaggtctccataaac

SEQ ID NO: 750 - DNA, 20 bp, Homo sapiens
ctggctcacctggacaacct

SEQ ID NO: 751 - DNA, 21 bp, Homo sapiens
ggccacaagaataagcagcaa

SEQ ID NO: 752 - DNA, 20 bp, Homo sapiens
tttgggcagcttgggtaagt

SEQ ID NO: 753 - DNA, 29 bp, Homo sapiens
ttcaaagttaaaagcaaacacttacagaa

SEQ ID NO: 754 - DNA, 20 bp, Homo sapiens
acgagtggagttgggtgtcg

SEQ ID NO: 755 - DNA, 20 bp, Homo sapiens
tgtgtgtgcttgtgcgtgtc

SEQ ID NO: 756 - DNA, 20 bp, Homo sapiens
agccgaggactggaagaagg

SEQ ID NO: 757 - DNA, 20 bp, Homo sapiens
gggggatgagttctggcagt

SEQ ID NO: 758 - DNA, 21 bp, Homo sapiens
ggggctactggagaggagaga

SEQ ID NO: 759 - DNA, 20 bp, Homo sapiens
tcaatgcaggcgtccaagta

SEQ ID NO: 760 - DNA, 24 bp, Homo sapiens
acgtgattttgctgtagaagatgg

SEQ ID NO: 761 - DNA, 31 bp, Homo sapiens
gactatgaggaatatttgcaagacatagaat

SEQ ID NO: 762 - DNA, 20 bp, Homo sapiens
ctgagctctggctttgcctt

SEQ ID NO: 763 - DNA, 20 bp, Homo sapiens
agtccagcctgagggctctt

SEQ ID NO: 764 - DNA, 20 bp, Homo sapiens
tgcagatgagacagcaacca

SEQ ID NO: 765 - DNA, 22 bp, Homo sapiens
tgccaaaatctcttctcccttc

SEQ ID NO: 766 - DNA, 20 bp, Homo sapiens
acagggagacccgtccattt

SEQ ID NO: 767 - DNA, 21 bp, Homo sapiens
aaacagaggccatggcagaat

SEQ ID NO: 768 - DNA, 25 bp, Homo sapiens
tgccgtgttattgtattaggtgtca

SEQ ID NO: 769 - DNA, 20 bp, Homo sapiens
gtccaccacttgctgggttt

SEQ ID NO: 770 - DNA, 20 bp, Homo sapiens
aagccagaagccaggaggag

SEQ ID NO: 771 - DNA, 24 bp, Homo sapiens
tgctgtactcaggtggcactaact

SEQ ID NO: 772 - DNA, 22 bp, Homo sapiens
tcccaaattgaatcactgctca

SEQ ID NO: 773 - DNA, 18 bp, Homo sapiens
tccactgccatcctccca

SEQ ID NO: 774 - DNA, 20 bp, Homo sapiens
tagggcctggcttctgtctg

SEQ ID NO: 775 - DNA, 25 bp, Homo sapiens
caaacatcactctgctgcttagaca

SEQ ID NO: 776 - DNA, 25 bp, Homo sapiens
gattaattcaccttccagtgtctcg

SEQ ID NO: 777 - DNA, 22 bp, Homo sapiens
tggcatgtcagacagaacttga

SEQ ID NO: 778 - DNA, 20 bp, Homo sapiens
ttgtggcttcctcagctcct

SEQ ID NO: 779 - DNA, 20 bp, Homo sapiens
gctgaccttcctcgcagaga

SEQ ID NO: 780 - DNA, 21 bp, Homo sapiens
tccctcagtcccaactccttt

SEQ ID NO: 781 - DNA, 19 bp, Homo sapiens
ttcatcttccccaagtgcg

SEQ ID NO: 782 - DNA, 19 bp, Homo sapiens
cttgtcctccgcactgcac

SEQ ID NO: 783 - DNA, 23 bp, Homo sapiens
tgggagttttgctgattccttct

SEQ ID NO: 784 - DNA, 28 bp, Homo sapiens
ctaagccagaaacactgtaaaactacca

SEQ ID NO: 785 - DNA, 21 bp, Homo sapiens
cccatccccacatcatattca

SEQ ID NO: 786 - DNA, 21 bp, Homo sapiens
cctctcacgacgcttctacca

SEQ ID NO: 787 - DNA, 20 bp, Homo sapiens
ttgcggcgtgtataccaatg

SEQ ID NO: 788 - DNA, 20 bp, Homo sapiens
gtggtgccttctggagagga

SEQ ID NO: 789 - DNA, 20 bp, Homo sapiens
tgttgtgccagggaaggttt

SEQ ID NO: 790 - DNA, 22 bp, Homo sapiens
cattcttcatcctcacccagga

SEQ ID NO: 791 - DNA, 27 bp, Homo sapiens
catgctttgagagtgattatttccttt

SEQ ID NO: 792 - DNA, 24 bp, Homo sapiens
tctcattagcctgaatgtgccata

SEQ ID NO: 793 - DNA, 20 bp, Homo sapiens
cggaggagattttcggacct

SEQ ID NO: 794 - DNA, 21 bp, Homo sapiens
ccttggaagatctgacccgaa

SEQ ID NO: 795 - DNA, 20 bp, Homo sapiens
gaggtggagctggtgcagat

SEQ ID NO: 796 - DNA, 20 bp, Homo sapiens
gcccagcctaggatctgaca

SEQ ID NO: 797 - DNA, 20 bp, Homo sapiens
gcagactgagcgggaaaaga

SEQ ID NO: 798 - DNA, 20 bp, Homo sapiens
tcccaaccgaacttcttcca

SEQ ID NO: 799 - DNA, 32 bp, Homo sapiens
tctacatgcaatgttagtaattctgaagtttt

SEQ ID NO: 800 - DNA, 20 bp, Homo sapiens
ccaggaggatggcaaagaga

SEQ ID NO: 801 - DNA, 20 bp, Homo sapiens
cgaccatccaagggagagtg

SEQ ID NO: 802 - DNA, 20 bp, Homo sapiens
gggctccaggactccctcta

SEQ ID NO: 803 - DNA, 20 bp, Homo sapiens
gcctcttcccatctcaacca

SEQ ID NO: 804 - DNA, 20 bp, Homo sapiens
ggtggatcaggccgttattg

SEQ ID NO: 805 - DNA, 20 bp, Homo sapiens
aggggagaccgaagtgaagg

SEQ ID NO: 806 - DNA, 23 bp, Homo sapiens
aaaaccgtatccttccctgttgt

SEQ ID NO: 807 - DNA, 20 bp, Homo sapiens
aagaggcagccgagagaatg

SEQ ID NO: 808 - DNA, 20 bp, Homo sapiens
acccgctgtttccagagttg

SEQ ID NO: 809 - DNA, 24 bp, Homo sapiens
tgggctaactatgcagagcatgta

SEQ ID NO: 810 - DNA, 20 bp, Homo sapiens
tggggcttctgagagattgg

SEQ ID NO: 811 - DNA, 20 bp, Homo sapiens
cttaaacttggcccggcatt

SEQ ID NO: 812 - DNA, 20 bp, Homo sapiens
cggtgccttcttaggagctg

SEQ ID NO: 813 - DNA, 21 bp, Homo sapiens
cctaggggagaccgaagtgaa

SEQ ID NO: 814 - DNA, 20 bp, Homo sapiens
tgctgcggcatagaatcaag

SEQ ID NO: 815 - DNA, 19 bp, Homo sapiens
tcgttgcaatcctcggtca

SEQ ID NO: 816 - DNA, 20 bp, Homo sapiens
agcagcaggtggaatccaag

SEQ ID NO: 817 - DNA, 20 bp, Homo sapiens
ggccatttcaggcagcataa

SEQ ID NO: 818 - DNA, 21 bp, Homo sapiens
ttctaccctgcggagatcaca

SEQ ID NO: 819 - DNA, 20 bp, Homo sapiens
gcttgtgcatgaccctgatg

SEQ ID NO: 820 - DNA, 20 bp, Homo sapiens
ttgccctctcctcacacgta

SEQ ID NO: 821 - DNA, 20 bp, Homo sapiens
cccctggaggttgtcttcaa

SEQ ID NO: 822 - DNA, 22 bp, Homo sapiens
tgccttgctacctcatcagaga

SEQ ID NO: 823 - DNA, 20 bp, Homo sapiens
agagagggcctgccttaacc

SEQ ID NO: 824 - DNA, 19 bp, Homo sapiens
tcccattccaccacagtgc

SEQ ID NO: 825 - DNA, 22 bp, Homo sapiens
tcaaggatcagtttcacccaca

SEQ ID NO: 826 - DNA, 19 bp, Homo sapiens
ttctccgagcttcgcaatg

SEQ ID NO: 827 - DNA, 20 bp, Homo sapiens
ggcatcctgggctacactga

SEQ ID NO: 828 - DNA, 20 bp, Homo sapiens
gcacgacgatgaggtgacag

SEQ ID NO: 829 - DNA, 20 bp, Homo sapiens
ccaaccaaaattgccccttt

SEQ ID NO: 830 - DNA, 20 bp, Homo sapiens
tgttaggcccctgtttcctg

SEQ ID NO: 831 - DNA, 19 bp, Homo sapiens
ctcatcatcctggccgtca

SEQ ID NO: 832 - DNA, 20 bp, Homo sapiens
tgttcactgcagcccatttg

SEQ ID NO: 833 - DNA, 21 bp, Homo sapiens
ttccaaaagccaaggtgagaa

SEQ ID NO: 834 - DNA, 21 bp, Homo sapiens
aaagttgctgtggttggttgc

SEQ ID NO: 835 - DNA, 21 bp, Homo sapiens
gaccatcccaaaatgcttcaa

SEQ ID NO: 836 - DNA, 21 bp, Homo sapiens
tggcgccaactttaaacattc

SEQ ID NO: 837 - DNA, 20 bp, Homo sapiens
cctcaaccccatgctttacg

SEQ ID NO: 838 - DNA, 20 bp, Homo sapiens
tcttcggctgctcctgactt

SEQ ID NO: 839 - DNA, 20 bp, Homo sapiens
tttctcctcctcccctcagc

SEQ ID NO: 840 - DNA, 20 bp, Homo sapiens
ttgagggcccttgacaaaag

SEQ ID NO: 841 - DNA, 24 bp, Homo sapiens
ccattatggtgctactgagcgttt

SEQ ID NO: 842 - DNA, 22 bp, Homo sapiens
aggggaagtttgtaccccattg

SEQ ID NO: 843 - DNA, 21 bp, Homo sapiens
ggctcttcagctgcttgtcct

SEQ ID NO: 844 - DNA, 20 bp, Homo sapiens
tcgtcgtggtggttttgttg

SEQ ID NO: 845 - DNA, 20 bp, Homo sapiens
tccgccatccctgctattta

SEQ ID NO: 846 - DNA, 20 bp, Homo sapiens
gatgcagagagccagcaagg

SEQ ID NO: 847 - DNA, 23 bp, Homo sapiens
cccaggtattacacaagccaaaa

SEQ ID NO: 848 - DNA, 20 bp, Homo sapiens
ctgactctgcccgacttcct

SEQ ID NO: 849 - DNA, 32 bp, Homo sapiens
ttcctatctaataaatgcctttaattgttctc

SEQ ID NO: 850 - DNA, 21 bp, Homo sapiens
gcgtcatggtgtctcatcgtt

SEQ ID NO: 851 - DNA, 20 bp, Homo sapiens
tgacatgactggctggttgc

SEQ ID NO: 852 - DNA, 20 bp, Homo sapiens
cacgacgtctccgcgtatct

SEQ ID NO: 853 - DNA, 20 bp, Homo sapiens
agttaacggcccaagtggtg

SEQ ID NO: 854 - DNA, 25 bp, Homo sapiens
agctgtttcatgtagctgctttagg

SEQ ID NO: 855 - DNA, 19 bp, Homo sapiens
gaaacacagcccgatggtg

SEQ ID NO: 856 - DNA, 20 bp, Homo sapiens
ttcctttcaccacccacacc

SEQ ID NO: 857 - DNA, 19 bp, Homo sapiens
gacccctccttccccttct

SEQ ID NO: 858 - DNA, 20 bp, Homo sapiens
cacccagtgctaccgagaca

SEQ ID NO: 859 - DNA, 18 bp, Homo sapiens
tgtcgctgctgtggttgc

SEQ ID NO: 860 - DNA, 20 bp, Homo sapiens
agccatgaagcacatggtca

SEQ ID NO: 861 - DNA, 20 bp, Homo sapiens
caatatgtgccgccagtgtt

SEQ ID NO: 862 - DNA, 28 bp, Homo sapiens
aatcttacacacaaatgaaaatgcaagt

SEQ ID NO: 863 - DNA, 20 bp, Homo sapiens
atgttgcggtaatcggagga

SEQ ID NO: 864 - DNA, 20 bp, Homo sapiens
cctgggtgtttgggtcagat

SEQ ID NO: 865 - DNA, 22 bp, Homo sapiens
ctgtcttcagctgggtcagaga

SEQ ID NO: 866 - DNA, 20 bp, Homo sapiens
gagcagggactctggagcag

SEQ ID NO: 867 - DNA, 21 bp, Homo sapiens
cagaaaacgcaggtgaaatgc

SEQ ID NO: 868 - DNA, 22 bp, Homo sapiens
gcgttataggtggagaccgagt

SEQ ID NO: 869 - DNA, 19 bp, Homo sapiens
tccacctttgggtcgcttt

SEQ ID NO: 870 - DNA, 20 bp, Homo sapiens
tctggtcttgggaggtgagg

SEQ ID NO: 871 - DNA, 20 bp, Homo sapiens
gcaccaggtggtctcctctg

SEQ ID NO: 872 - DNA, 20 bp, Homo sapiens
ctaccccacagcaggtagcc

SEQ ID NO: 873 - DNA, 20 bp, Homo sapiens
cctgaccaacattgcgattg

SEQ ID NO: 874 - DNA, 20 bp, Homo sapiens
cccatgccagtgatcctacc

SEQ ID NO: 875 - DNA, 20 bp, Homo sapiens
tcctcctggaccgtgagaag

SEQ ID NO: 876 - DNA, 23 bp, Homo sapiens
gattcctcttggacccacttttc

SEQ ID NO: 877 - DNA, 20 bp, Homo sapiens
gctagccccatcctcactca

SEQ ID NO: 878 - DNA, 21 bp, Homo sapiens
ccgaaagcctcctggaaatta

SEQ ID NO: 879 - DNA, 20 bp, Homo sapiens
gcatcatgttgaccgagctg

SEQ ID NO: 880 - DNA, 27 bp, Homo sapiens
tgtggaaagttttccctcatatactca

SEQ ID NO: 881 - DNA, 21 bp, Homo sapiens
gggagacctgcctctcagaat

SEQ ID NO: 882 - DNA, 20 bp, Homo sapiens
tgcagagccccaattcctac

SEQ ID NO: 883 - DNA, 18 bp, Homo sapiens
gccccacgtgtgaccatt

SEQ ID NO: 884 - DNA, 24 bp, Homo sapiens
tcgttgtgtaatcgtgtcagaaaa

SEQ ID NO: 885 - DNA, 20 bp, Homo sapiens
aacaagctgtccagcgaagc

SEQ ID NO: 886 - DNA, 20 bp, Homo sapiens
cggtacccaattcgccctat

SEQ ID NO: 887 - DNA, 20 bp, Homo sapiens
accctgtggtggtcttggac

SEQ ID NO: 888 - DNA, 20 bp, Homo sapiens
gccgtatacaacggcgagac

SEQ ID NO: 889 - DNA, 21 bp, Homo sapiens
aagagccagcagagcaaaaca

SEQ ID NO: 890 - DNA, 22 bp, Homo sapiens
ttacgtgtgcacagagaggtca

SEQ ID NO: 891 - DNA, 20 bp, Homo sapiens
ggtggcacctaccgtctgtt

SEQ ID NO: 892 - DNA, 20 bp, Homo sapiens
tgtgttccctggtgatgtgg

SEQ ID NO: 893 - DNA, 20 bp, Homo sapiens
cttcgtggaggctgtggaac

SEQ ID NO: 894 - DNA, 20 bp, Homo sapiens
tgaggcctgagtccttctgg

SEQ ID NO: 895 - DNA, 20 bp, Homo sapiens
atttcgcaggccttcctctc

SEQ ID NO: 896 - DNA, 21 bp, Homo sapiens
tgtgtgtgcaccttgtcttcc

SEQ ID NO: 897 - DNA, 20 bp, Homo sapiens
gtcctggcaacatggagagg

SEQ ID NO: 898 - DNA, 27 bp, Homo sapiens
ccctaattgctaagatttaaggacgtt

SEQ ID NO: 899 - DNA, 25 bp, Homo sapiens
ttgagggagtagtggaatgaaaaca

SEQ ID NO: 900 - DNA, 20 bp, Homo sapiens
tgggagaactccaatgctga

SEQ ID NO: 901 - DNA, 20 bp, Homo sapiens
gcaccagcagggatggatta

SEQ ID NO: 902 - DNA, 20 bp, Homo sapiens
gcctggaccgatgtgtctct

SEQ ID NO: 903 - DNA, 22 bp, Homo sapiens
cagccacagccttttaatttgg

SEQ ID NO: 904 - DNA, 20 bp, Homo sapiens
aagacacccgcatcttcctg

SEQ ID NO: 905 - DNA, 20 bp, Homo sapiens
gggagacctgctctgcaaaa

SEQ ID NO: 906 - DNA, 22 bp, Homo sapiens
cccaaactgatcttccaggcta

SEQ ID NO: 907 - DNA, 20 bp, Homo sapiens
ttcccctctcatcgtcatgg

SEQ ID NO: 908 - DNA, 20 bp, Homo sapiens
ccaaggacctgggatctcct

SEQ ID NO: 909 - DNA, 20 bp, Homo sapiens
gaaaaccacggaggtggatg

SEQ ID NO: 910 - DNA, 20 bp, Homo sapiens
tggaggcagagtgacggact

SEQ ID NO: 911 - DNA, 20 bp, Homo sapiens
gtaggcacgcacgaagaaca

SEQ ID NO: 912 - DNA, 20 bp, Homo sapiens
cctccgcagatgcttcattt

SEQ ID NO: 913 - DNA, 27 bp, Homo sapiens
tttgttttgagttttcaaagaatagcc

SEQ ID NO: 914 - DNA, 22 bp, Homo sapiens
ggtacagcacttggctgggtta

SEQ ID NO: 915 - DNA, 31 bp, Homo sapiens
tttgtacatgactctcattttattgtttctt

SEQ ID NO: 916 - DNA, 20 bp, Homo sapiens
cctgcttggggaaatgttca

SEQ ID NO: 917 - DNA, 19 bp, Homo sapiens
gtgggcttcagggttggag

SEQ ID NO: 918 - DNA, 20 bp, Homo sapiens
cctggatgtcagcgaagagg

SEQ ID NO: 919 - DNA, 21 bp, Homo sapiens
caagcttcactggctctctgg

SEQ ID NO: 920 - DNA, 20 bp, Homo sapiens
gcccaaaactgctccaaaga

SEQ ID NO: 921 - DNA, 22 bp, Homo sapiens
gcctttccagtacaggcacttt

SEQ ID NO: 922 - DNA, 20 bp, Homo sapiens
gcgcggtgaggttgtctagt

SEQ ID NO: 923 - DNA, 26 bp, Homo sapiens
tcaacactacacatgaatgaatccaa

SEQ ID NO: 924 - DNA, 29 bp, Homo sapiens
tggaaatgtaaccattttaggataatgtc

SEQ ID NO: 925 - DNA, 21 bp, Homo sapiens
cccaagagagaacagggtggt

SEQ ID NO: 926 - DNA, 32 bp, Homo sapiens
cactcagtaaagacaatttccataaaataaaa

SEQ ID NO: 927 - DNA, 20 bp, Homo sapiens
ccgcccgtaattaaatagca

SEQ ID NO: 928 - DNA, 20 bp, Homo sapiens
cctgcagcagatgcctcttt

SEQ ID NO: 929 - DNA, 20 bp, Homo sapiens
tcccctgggttgctaattga

SEQ ID NO: 930 - DNA, 20 bp, Homo sapiens
gccttcatttccgcaggtta

SEQ ID NO: 931 - DNA, 20 bp, Homo sapiens
cgtctggtgacaaccgagtg

SEQ ID NO: 932 - DNA, 21 bp, Homo sapiens
tggcagggtaaggagtgtttg

SEQ ID NO: 933 - DNA, 20 bp, Homo sapiens
atcgcttttggcgacagact

SEQ ID NO: 934 - DNA, 20 bp, Homo sapiens
tcctgagctcgccaataagc

SEQ ID NO: 935 - DNA, 20 bp, Homo sapiens
tggcaccaaaaggcacaata

SEQ ID NO: 936 - DNA, 20 bp, Homo sapiens
caagagatgcagtgccagga

SEQ ID NO: 937 - DNA, 20 bp, Homo sapiens
agaggaggaggctgctggtt

SEQ ID NO: 938 - DNA, 20 bp, Homo sapiens
gctcgcccacaaactgattt

SEQ ID NO: 939 - DNA, 25 bp, Homo sapiens
tgatttggatacggtgaataagctg

SEQ ID NO: 940 - DNA, 20 bp, Homo sapiens
cggcaaagagaacggaaaga

SEQ ID NO: 941 - DNA, 20 bp, Homo sapiens
gatcccagcccacaagtgat

SEQ ID NO: 942 - DNA, 27 bp, Homo sapiens
acttgttaacctttctaaccttcacga

SEQ ID NO: 943 - DNA, 20 bp, Homo sapiens
agtaagtcagggcgggcttt

SEQ ID NO: 944 - DNA, 20 bp, Homo sapiens
tcttcacccatcatggagca

SEQ ID NO: 945 - DNA, 20 bp, Homo sapiens
cattcagcggacagcaaaca

SEQ ID NO: 946 - DNA, 20 bp, Homo sapiens
ttgtccatggcaaaacagga

SEQ ID NO: 947 - DNA, 20 bp, Homo sapiens
aggtcctcctccccttttcc

SEQ ID NO: 948 - DNA, 20 bp, Homo sapiens
tcacactctgcacccctcag

SEQ ID NO: 949 - DNA, 24 bp, Homo sapiens
caacattggctggtaataggcttt

SEQ ID NO: 950 - DNA, 20 bp, Homo sapiens
tccactgccctaacacacga

SEQ ID NO: 951 - DNA, 21 bp, Homo sapiens
acccattttacagtgccatgc

SEQ ID NO: 952 - DNA, 20 bp, Homo sapiens
gctctttgcctgctggtttc

SEQ ID NO: 953 - DNA, 20 bp, Homo sapiens
cgaacgagtcatggcctagc

SEQ ID NO: 954 - DNA, 20 bp, Homo sapiens
ggtaagcacatcccctcgaa

SEQ ID NO: 955 - DNA, 25 bp, Homo sapiens
cccataaccaaaatttaaaggcaaa

SEQ ID NO: 956 - DNA, 21 bp, Homo sapiens
tggcatgttttgtgcatttgt

SEQ ID NO: 957 - DNA, 20 bp, Homo sapiens
ccatggggtgagacttgagc

SEQ ID NO: 958 - DNA, 20 bp, Homo sapiens
tttctccagaagcccagcac

SEQ ID NO: 959 - DNA, 25 bp, Homo sapiens
ttttttttcaagcagtaaaattcca

SEQ ID NO: 960 - DNA, 20 bp, Homo sapiens
cactctgcgccacaaaggtt

SEQ ID NO: 961 - DNA, 20 bp, Homo sapiens
gaagcccctcaccctgagat

SEQ ID NO: 962 - DNA, 20 bp, Homo sapiens
ccgtacaagtcgggtgggta

SEQ ID NO: 963 - DNA, 20 bp, Homo sapiens
gcaaagtgaggagggagctg

SEQ ID NO: 964 - DNA, 20 bp, Homo sapiens
cagggctatgagcggaagaa

SEQ ID NO: 965 - DNA, 20 bp, Homo sapiens
gacccgccaaaaccaaatta

SEQ ID NO: 966 - DNA, 20 bp, Homo sapiens
gacgtcattgtcggcgactt

SEQ ID NO: 967 - DNA, 20 bp, Homo sapiens
cttccagcagaccccagtgt

SEQ ID NO: 968 - DNA, 20 bp, Homo sapiens
cctctgctgggttgttaccg

SEQ ID NO: 969 - DNA, 21 bp, Homo sapiens
tgaatcccttgctgttcccta

SEQ ID NO: 970 - DNA, 20 bp, Homo sapiens
taccttggctccctgtcctg

SEQ ID NO: 971 - DNA, 20 bp, Homo sapiens
taggggtaagccctgggtgt

SEQ ID NO: 972 - DNA, 21 bp, Homo sapiens
ttccatcctgtcctggaatca

SEQ ID NO: 973 - DNA, 20 bp, Homo sapiens
gggcacagcttcctctcttg

SEQ ID NO: 974 - DNA, 20 bp, Homo sapiens
ccctgccacacacacatttt

SEQ ID NO: 975 - DNA, 20 bp, Homo sapiens
cccttgtgtccccacatttt

SEQ ID NO: 976 - DNA, 20 bp, Homo sapiens
ctgcagcctcacagacctga

SEQ ID NO: 977 - DNA, 21 bp, Homo sapiens
tgccattgtcccatctaggaa

SEQ ID NO: 978 - DNA, 21 bp, Homo sapiens
tcagggatttctaagccacca

SEQ ID NO: 979 - DNA, 20 bp, Homo sapiens
agcagggaattccaggaagc

SEQ ID NO: 980 - DNA, 20 bp, Homo sapiens
gcctcctgtagtcgctttgc

SEQ ID NO: 981 - DNA, 20 bp, Homo sapiens
gcacggttcaaaagcaggtt

SEQ ID NO: 982 - DNA, 20 bp, Homo sapiens
gagccctcgcctctttcttc

SEQ ID NO: 983 - DNA, 20 bp, Homo sapiens
ggtggtgtgcagagcgtatg

SEQ ID NO: 984 - DNA, 20 bp, Homo sapiens
accgacgagaccagaagtgg

SEQ ID NO: 985 - DNA, 27 bp, Homo sapiens
ttctgttggagtattttcttccttacg

SEQ ID NO: 986 - DNA, 20 bp, Homo sapiens
cacacttgtgggcaatctgg

SEQ ID NO: 987 - DNA, 20 bp, Homo sapiens
cccgtggagctgacaagttt

SEQ ID NO: 988 - DNA, 20 bp, Homo sapiens
agtgccccaggcatttcttt

SEQ ID NO: 989 - DNA, 20 bp, Homo sapiens
gcctttgctgggcattatgt

SEQ ID NO: 990 - DNA, 20 bp, Homo sapiens
ccgagccaagacgagaagaa

SEQ ID NO: 991 - DNA, 20 bp, Homo sapiens
cctgcatttgaccagagcaa

SEQ ID NO: 992 - DNA, 25 bp, Homo sapiens
tgcaacactaacaagagagaatgga

SEQ ID NO: 993 - DNA, 20 bp, Homo sapiens
aggcccagacttctccaagg

SEQ ID NO: 994 - DNA, 20 bp, Homo sapiens
aggccaagtcaggcccttat

SEQ ID NO: 995 - DNA, 20 bp, Homo sapiens
ttgccagaatgggactgtga

SEQ ID NO: 996 - DNA, 20 bp, Homo sapiens
gcaagcttatgacccgcact

SEQ ID NO: 997 - DNA, 20 bp, Homo sapiens
tggcttttaggatggcaagg

SEQ ID NO: 998 - DNA, 19 bp, Homo sapiens
ccgataagggcgaggtctg

SEQ ID NO: 999 - DNA, 22 bp, Homo sapiens
tttcccccaaattctaagcaga

SEQ ID NO: 1000 - DNA, 20 bp, Homo sapiens
ccagagcccaggtttctcaa

SEQ ID NO: 1001 - DNA, 20 bp, Homo sapiens
ggcaagtgaggggatgagtg

SEQ ID NO: 1002 - DNA, 20 bp, Homo sapiens
ggcgctctctatgtgggtgt

SEQ ID NO: 1003 - DNA, 21 bp, Homo sapiens
gggtcattagaagccccttca

SEQ ID NO: 1004 - DNA, 20 bp, Homo sapiens
cccatgttcccgaagtagga

SEQ ID NO: 1005 - DNA, 20 bp, Homo sapiens
ggggaggtggataggcaaac

SEQ ID NO: 1006 - DNA, 20 bp, Homo sapiens
ttttcagccccttgcttctg

SEQ ID NO: 1007 - DNA, 21 bp, Homo sapiens
ggacgtctttggttgggattt

SEQ ID NO: 1008 - DNA, 20 bp, Homo sapiens
gaaggaggggtgggttgttc

SEQ ID NO: 1009 - DNA, 20 bp, Homo sapiens
ttgacttggcccagagggta

SEQ ID NO: 1010 - DNA, 20 bp, Homo sapiens
actcgaacactgcagcatgg

SEQ ID NO: 1011 - DNA, 20 bp, Homo sapiens
cccatggatgatgactgctg

SEQ ID NO: 1012 - DNA, 22 bp, Homo sapiens
ggtggttttacagtccctgcat

SEQ ID NO: 1013 - DNA, 20 bp, Homo sapiens
tgccaaaccttgagtgatgg

SEQ ID NO: 1014 - DNA, 20 bp, Homo sapiens
atcgtcttggtcgccactgt

SEQ ID NO: 1015 - DNA, 20 bp, Homo sapiens
tgtgcgttgcctgaatgaac

SEQ ID NO: 1016 - DNA, 20 bp, Homo sapiens
ggaggaagccatggagatca

SEQ ID NO: 1017 - DNA, 20 bp, Homo sapiens
tctccccacttgaagcgtct

SEQ ID NO: 1018 - DNA, 20 bp, Homo sapiens
tgcaaaatgcatgccctgta

SEQ ID NO: 1019 - DNA, 20 bp, Homo sapiens
ccgaccgtccataggatacg

SEQ ID NO: 1020 - DNA, 20 bp, Homo sapiens
ctttggaaaggtgcgagagc

SEQ ID NO: 1021 - DNA, 20 bp, Homo sapiens
tccagggaactgggagtgag

SEQ ID NO: 1022 - DNA, 20 bp, Homo sapiens
tcccttctcggaccagtgtc

SEQ ID NO: 1023 - DNA, 20 bp, Homo sapiens
gtaggggccatcggataagc

SEQ ID NO: 1024 - DNA, 20 bp, Homo sapiens
accaccaacaacccacatcc

SEQ ID NO: 1025 - DNA, 20 bp, Homo sapiens
ggatccccactggcatttct

SEQ ID NO: 1026 - DNA, 20 bp, Homo sapiens
gaagaagccgaccttccaca

SEQ ID NO: 1027 - DNA, 20 bp, Homo sapiens
ctgtagtcacggcccagctc

SEQ ID NO: 1028 - DNA, 20 bp, Homo sapiens
atagacaccaggcccacgag

SEQ ID NO: 1029 - DNA, 20 bp, Homo sapiens
ggggaaggacaggaacatcc

SEQ ID NO: 1030 - DNA, 20 bp, Homo sapiens
tgtcgtcgatgctcttcacc

SEQ ID NO: 1031 - DNA, 20 bp, Homo sapiens
ccctggcccacaagtatcac

SEQ ID NO: 1032 - DNA, 20 bp, Homo sapiens
gccctggctcacaagtacca

SEQ ID NO: 1033 - DNA, 20 bp, Homo sapiens
atggcagagggagacgacag

SEQ ID NO: 1034 - DNA, 20 bp, Homo sapiens
gctttgtggcatctcccaag

SEQ ID NO: 1035 - DNA, 20 bp, Homo sapiens
ttcagcggtactcggaaacc

SEQ ID NO: 1036 - DNA, 20 bp, Homo sapiens
caggcatctggattggctct

SEQ ID NO: 1037 - DNA, 20 bp, Homo sapiens
attccgaaaccaccggactt

SEQ ID NO: 1038 - DNA, 21 bp, Homo sapiens
cgactccactcagcatcttgc

SEQ ID NO: 1039 - DNA, 20 bp, Homo sapiens
tgggatgaggatgtgtcgag

SEQ ID NO: 1040 - DNA, 23 bp, Homo sapiens
gccatacctctaggctggctatc

SEQ ID NO: 1041 - DNA, 20 bp, Homo sapiens
ctgcgcattctcaagggttt

SEQ ID NO: 1042 - DNA, 23 bp, Homo sapiens
ttccggaagtcatttcactaagc

SEQ ID NO: 1043 - DNA, 20 bp, Homo sapiens
aggattgaccgtcccctctc

SEQ ID NO: 1044 - DNA, 20 bp, Homo sapiens
caccctccagttcccactgt

SEQ ID NO: 1045 - DNA, 20 bp, Homo sapiens
tcaacagcaacaagcccgta

SEQ ID NO: 1046 - DNA, 19 bp, Homo sapiens
agcagttccacccctctgg

SEQ ID NO: 1047 - DNA, 20 bp, Homo sapiens
ccggccaacccctttaaata

SEQ ID NO: 1048 - DNA, 20 bp, Homo sapiens
tcagcgtggctatcagttgg

SEQ ID NO: 1049 - DNA, 20 bp, Homo sapiens
caagtgcggagacccatctt

SEQ ID NO: 1050 - DNA, 22 bp, Homo sapiens
acagccatcaagaaaggacaca

SEQ ID NO: 1051 - DNA, 21 bp, Homo sapiens
ccacctgcatccaaataatgg

SEQ ID NO: 1052 - DNA, 20 bp, Homo sapiens
tccaaagggttgcttgaagg

SEQ ID NO: 1053 - DNA, 20 bp, Homo sapiens
ccatggaagggtccaatgag

SEQ ID NO: 1054 - DNA, 19 bp, Homo sapiens
gcctgctcctcttggatgg

SEQ ID NO: 1055 - DNA, 20 bp, Homo sapiens
aaataggggacctgcccagt

SEQ ID NO: 1056 - DNA, 20 bp, Homo sapiens
tgtaggcgccaaggtggtat

SEQ ID NO: 1057 - DNA, 21 bp, Homo sapiens
gttgccacagaaggagggttt

SEQ ID NO: 1058 - DNA, 22 bp, Homo sapiens
tccattcaccgtcaagactgaa

SEQ ID NO: 1059 - DNA, 22 bp, Homo sapiens
tattcccattcttctgccatgc

SEQ ID NO: 1060 - DNA, 20 bp, Homo sapiens
ggtgaagaggtggagggtga

SEQ ID NO: 1061 - DNA, 20 bp, Homo sapiens
ggtgtctggtttgggtccag

SEQ ID NO: 1062 - DNA, 20 bp, Homo sapiens
aacaggcgacctttcagcag

SEQ ID NO: 1063 - DNA, 20 bp, Homo sapiens
aggcatgaaggatgccaaga

SEQ ID NO: 1064 - DNA, 20 bp, Homo sapiens
ccaggacctcctgcttagcc

SEQ ID NO: 1065 - DNA, 20 bp, Homo sapiens
cacaggggagaagccatacg

SEQ ID NO: 1066 - DNA, 20 bp, Homo sapiens
tcatgaggctgtgctggaag

SEQ ID NO: 1067 - DNA, 22 bp, Homo sapiens
ggcttctctgtgaattgcctgt

SEQ ID NO: 1068 - DNA, 20 bp, Homo sapiens
ggctccaatggtttccacaa

SEQ ID NO: 1069 - DNA, 20 bp, Homo sapiens
ggtccatgtctttggggatg

SEQ ID NO: 1070 - DNA, 24 bp, Homo sapiens
gactgtggagttttggctgtttta

SEQ ID NO: 1071 - DNA, 20 bp, Homo sapiens
tcattacagcgggggcttag

SEQ ID NO: 1072 - DNA, 21 bp, Homo sapiens
ttggcctctttcagcctcttt

SEQ ID NO: 1073 - DNA, 19 bp, Homo sapiens
cctgcagtgggccctagtc

SEQ ID NO: 1074 - DNA, 20 bp, Homo sapiens
gagcacatccccaaaatcca

SEQ ID NO: 1075 - DNA, 20 bp, Homo sapiens
gatcagctgcttgtgcctgt

SEQ ID NO: 1076 - DNA, 20 bp, Homo sapiens
cagccacagtcttccccaat

SEQ ID NO: 1077 - DNA, 20 bp, Homo sapiens
aaccttcatgcaccccattc

SEQ ID NO: 1078 - DNA, 20 bp, Homo sapiens
agtgcatgtttgggacagca

SEQ ID NO: 1079 - DNA, 20 bp, Homo sapiens
ctgtggtgctcttggtctgc

SEQ ID NO: 1080 - DNA, 23 bp, Homo sapiens
agttcaacccaaatgatcaggaa

SEQ ID NO: 1081 - DNA, 20 bp, Homo sapiens
gcccaggagcctgaagttct

SEQ ID NO: 1082 - DNA, 23 bp, Homo sapiens
accaaaatgagaacctcaacagc

SEQ ID NO: 1083 - DNA, 27 bp, Homo sapiens
aatttctggaaaagtcaacaggataca

SEQ ID NO: 1084 - DNA, 25 bp, Homo sapiens
ttgatgatgtctctcactctgttcc

SEQ ID NO: 1085 - DNA, 20 bp, Homo sapiens
ttgagtggctgggactccat

SEQ ID NO: 1086 - DNA, 20 bp, Homo sapiens
ccggccacattcactgattt

SEQ ID NO: 1087 - DNA, 20 bp, Homo sapiens
aagcggtcgatggtcttctg

SEQ ID NO: 1088 - DNA, 24 bp, Homo sapiens
gatggaaaccagagacaaaaacga

SEQ ID NO: 1089 - DNA, 20 bp, Homo sapiens
gagaattccggaacctgtgg

SEQ ID NO: 1090 - DNA, 20 bp, Homo sapiens
cccaacttcctgacggttca

SEQ ID NO: 1091 - DNA, 21 bp, Homo sapiens
ggtgctgaaatcaacccactc

SEQ ID NO: 1092 - DNA, 28 bp, Homo sapiens
agaattgatttaggaaagtcacaaacct

SEQ ID NO: 1093 - DNA, 20 bp, Homo sapiens
tgcagtgttcctcccttcct

SEQ ID NO: 1094 - DNA, 20 bp, Homo sapiens
gcccagtggacaggtttctg

SEQ ID NO: 1095 - DNA, 25 bp, Homo sapiens
cctgatatgttttaagtgggaagca

SEQ ID NO: 1096 - DNA, 25 bp, Homo sapiens
tgatcacatgaagtcacattggttt

SEQ ID NO: 1097 - DNA, 19 bp, Homo sapiens
agatgatccccgcacatga

SEQ ID NO: 1098 - DNA, 20 bp, Homo sapiens
ctgcctgggacctcattcat

SEQ ID NO: 1099 - DNA, 23 bp, Homo sapiens
ccatgtatttgcaacagcagaga

SEQ ID NO: 1100 - DNA, 20 bp, Homo sapiens
gccaaacctgcaaacaaaca

SEQ ID NO: 1101 - DNA, 21 bp, Homo sapiens
gggaccgctttcttacctgtt

SEQ ID NO: 1102 - DNA, 23 bp, Homo sapiens
cagtcattggtgtctttggagtg

SEQ ID NO: 1103 - DNA, 20 bp, Homo sapiens
gatctccaccggacagcact

SEQ ID NO: 1104 - DNA, 30 bp, Homo sapiens
cacatacattttcagatatttctaccttcc

SEQ ID NO: 1105 - DNA, 20 bp, Homo sapiens
gttcattctgccccatcagc

SEQ ID NO: 1106 - DNA, 24 bp, Homo sapiens
tccaaggtctgatcatcttcttga

SEQ ID NO: 1107 - DNA, 23 bp, Homo sapiens
gctttcaagaatgaagtggttgg

SEQ ID NO: 1108 - DNA, 24 bp, Homo sapiens
gtcaacaatatttggaagcaccag

SEQ ID NO: 1109 - DNA, 20 bp, Homo sapiens
tttaggcaaaggggagcaca

SEQ ID NO: 1110 - DNA, 20 bp, Homo sapiens
ccaaaggaagccctcagaga

SEQ ID NO: 1111 - DNA, 21 bp, Homo sapiens
gggcacaaatgcaaagtaagc

SEQ ID NO: 1112 - DNA, 18 bp, Homo sapiens
cctgggctgtggcttcat

SEQ ID NO: 1113 - DNA, 21 bp, Homo sapiens
caggtggattcgtggtgctaa

SEQ ID NO: 1114 - DNA, 21 bp, Homo sapiens
gttttggggtgttgagggagt

SEQ ID NO: 1115 - DNA, 24 bp, Homo sapiens
ttcacagtgtgtggtcaacatttc

SEQ ID NO: 1116 - DNA, 20 bp, Homo sapiens
ccctctcatctagcccacca

SEQ ID NO: 1117 - DNA, 20 bp, Homo sapiens
cacagaggaggctgcagatg

SEQ ID NO: 1118 - DNA, 22 bp, Homo sapiens
tgattggaagccacaaatttca

SEQ ID NO: 1119 - DNA, 20 bp, Homo sapiens
gggagactgctcccatctca

SEQ ID NO: 1120 - DNA, 20 bp, Homo sapiens
tgacctcagacgtggagcag

SEQ ID NO: 1121 - DNA, 20 bp, Homo sapiens
tggggttggagctcaatctt

SEQ ID NO: 1122 - DNA, 27 bp, Homo sapiens
ctgttgatctgtttcttgaactttcct

SEQ ID NO: 1123 - DNA, 23 bp, Homo sapiens
taaaacccacagtgcttgacaca

SEQ ID NO: 1124 - DNA, 20 bp, Homo sapiens
ggagcaggggtagagccact

SEQ ID NO: 1125 - DNA, 21 bp, Homo sapiens
ggccagaatttccttctccac

SEQ ID NO: 1126 - DNA, 19 bp, Homo sapiens
catttctgggcaggcatga

SEQ ID NO: 1127 - DNA, 20 bp, Homo sapiens
gagacaccccagcccctagt

SEQ ID NO: 1128 - DNA, 20 bp, Homo sapiens
gatgctctgccacagctcct

SEQ ID NO: 1129 - DNA, 20 bp, Homo sapiens
ctgtcttcaaggggccagtg

SEQ ID NO: 1130 - DNA, 29 bp, Homo sapiens
aattaatctggacagtttcatctgaagag

SEQ ID NO: 1131 - DNA, 20 bp, Homo sapiens
ctctggccaactgcctgttt

SEQ ID NO: 1132 - DNA, 20 bp, Homo sapiens
tccctgccagtctcgaaaag

SEQ ID NO: 1133 - DNA, 20 bp, Homo sapiens
gcttggcccataagtgtgct

SEQ ID NO: 1134 - DNA, 20 bp, Homo sapiens
agccccttcaatcccatcat

SEQ ID NO: 1135 - DNA, 20 bp, Homo sapiens
tcctcaaacccgtggatcat

SEQ ID NO: 1136 - DNA, 20 bp, Homo sapiens
cggtgccttcttaggagctg

SEQ ID NO: 1137 - DNA, 25 bp, Homo sapiens
aaaaggaggacaagtctaacggaat

SEQ ID NO: 1138 - DNA, 21 bp, Homo sapiens
tgatggttattcgctggttcg

SEQ ID NO: 1139 - DNA, 21 bp, Homo sapiens
tctgccaggacatctttctcg

SEQ ID NO: 1140 - DNA, 25 bp, Homo sapiens
cacatcatgcagctccttaatacaa

SEQ ID NO: 1141 - DNA, 20 bp, Homo sapiens
gctgcatccagcctctgttt

SEQ ID NO: 1142 - DNA, 20 bp, Homo sapiens
aacagccagaatcgctggag

SEQ ID NO: 1143 - DNA, 20 bp, Homo sapiens
aggggagaccgaagtgaagg

SEQ ID NO: 1144 - DNA, 17 bp, Homo sapiens
ctctggcccgataccgg

SEQ ID NO: 1145 - DNA, 20 bp, Homo sapiens
ctgcaaacatcctcccatca

SEQ ID NO: 1146 - DNA, 20 bp, Homo sapiens
ggccgaagaatccctcaaaa

SEQ ID NO: 1147 - DNA, 21 bp, Homo sapiens
ttggccattgaccattacctg

SEQ ID NO: 1148 - DNA, 21 bp, Homo sapiens
tttggggataatccgtgttca

SEQ ID NO: 1149 - DNA, 20 bp, Homo sapiens
gtgtcctgggtctggtcctc

SEQ ID NO: 1150 - DNA, 26 bp, Homo sapiens
cttagggaattttggaacagaacatt

SEQ ID NO: 1151 - DNA, 20 bp, Homo sapiens
gccgtcccctcctctctcta

SEQ ID NO: 1152 - DNA, 22 bp, Homo sapiens
aattattgccttttcccctgga

SEQ ID NO: 1153 - DNA, 20 bp, Homo sapiens
ccagctacaacggatgcaaa

SEQ ID NO: 1154 - DNA, 20 bp, Homo sapiens
tcccggtccactgcttaaaa

SEQ ID NO: 1155 - DNA, 20 bp, Homo sapiens
tcaggggtttcccagttgag

SEQ ID NO: 1156 - DNA, 20 bp, Homo sapiens
atcatcacggtatggcgttg

SEQ ID NO: 1157 - DNA, 19 bp, Homo sapiens
ccccggatttgttcactgg

SEQ ID NO: 1158 - DNA, 20 bp, Homo sapiens
agtggtcgttgagggcaatg

SEQ ID NO: 1159 - DNA, 19 bp, Homo sapiens
cagggcctttgcaaacaag

SEQ ID NO: 1160 - DNA, 21 bp, Homo sapiens
ttttggaacccttagccctgt

SEQ ID NO: 1161 - DNA, 19 bp, Homo sapiens
ccatctctgacccgccttc

SEQ ID NO: 1162 - DNA, 20 bp, Homo sapiens
ggaccatggtggaggtgaaa

SEQ ID NO: 1163 - DNA, 20 bp, Homo sapiens
ctgactgctgcggcctctac

SEQ ID NO: 1164 - DNA, 23 bp, Homo sapiens
gtttgcaggtttggcataaattg

SEQ ID NO: 1165 - DNA, 31 bp, Homo sapiens
actaggtgaccagatacatgagtcttatttt

SEQ ID NO: 1166 - DNA, 20 bp, Homo sapiens
ccattggagaaatggctggt

SEQ ID NO: 1167 - DNA, 20 bp, Homo sapiens
ttttctggagcggccatatc

SEQ ID NO: 1168 - DNA, 20 bp, Homo sapiens
gggctgagtcctcagacagg

SEQ ID NO: 1169 - DNA, 20 bp, Homo sapiens
aactgaggctgccctagcaa

SEQ ID NO: 1170 - DNA, 20 bp, Homo sapiens
ccttcctgccctaacagcaa

SEQ ID NO: 1171 - DNA, 19 bp, Homo sapiens
caccgtcagtcgtgggtgt

SEQ ID NO: 1172 - DNA, 22 bp, Homo sapiens
cctggtagggaaaagtgatgga

SEQ ID NO: 1173 - DNA, 23 bp, Homo sapiens
tggaaaacaacacagcaaaatcc

SEQ ID NO: 1174 - DNA, 21 bp, Homo sapiens
aaatgacctttggtgccactg

SEQ ID NO: 1175 - DNA, 21 bp, Homo sapiens
tggaggagaggaaaacggaga

SEQ ID NO: 1176 - DNA, 21 bp, Homo sapiens
aatagcagcaaggggaagacc

SEQ ID NO: 1177 - DNA, 21 bp, Homo sapiens
atctaaatggtccgcctgagc

SEQ ID NO: 1178 - DNA, 21 bp, Homo sapiens
gcacaacttggtaaggcacca

SEQ ID NO: 1179 - DNA, 20 bp, Homo sapiens
tgggaagaggaagggacaca

SEQ ID NO: 1180 - DNA, 29 bp, Homo sapiens
tgcacataacatatatttgcctattgttt

SEQ ID NO: 1181 - DNA, 20 bp, Homo sapiens
caaggggcaccagtcttgat

SEQ ID NO: 1182 - DNA, 20 bp, Homo sapiens
tggctggagataggctttgg

SEQ ID NO: 1183 - DNA, 20 bp, Homo sapiens
tttgtcgtgtccgtggtttg

SEQ ID NO: 1184 - DNA, 20 bp, Homo sapiens
ttggcagtttcccctgactt

SEQ ID NO: 1185 - DNA, 21 bp, Homo sapiens
agcagtcttcctgtgctccag

SEQ ID NO: 1186 - DNA, 20 bp, Homo sapiens
acactgctaccctgcgctct

SEQ ID NO: 1187 - DNA, 20 bp, Homo sapiens
gcccagttttgggctttctc

SEQ ID NO: 1188 - DNA, 22 bp, Homo sapiens
catagccatttctgcagcacac

SEQ ID NO: 1189 - DNA, 20 bp, Homo sapiens
tcgtggaactgcttgacagc

SEQ ID NO: 1190 - DNA, 20 bp, Homo sapiens
aaccagaccggtcacttcca

SEQ ID NO: 1191 - DNA, 20 bp, Homo sapiens
cccacatccgcatctgctat

SEQ ID NO: 1192 - DNA, 20 bp, Homo sapiens
gatgccccggataatcctct

SEQ ID NO: 1193 - DNA, 19 bp, Homo sapiens
ccttttctggcagggcttc

SEQ ID NO: 1194 - DNA, 20 bp, Homo sapiens
gcacagccgatgcttgtaac

SEQ ID NO: 1195 - DNA, 20 bp, Homo sapiens
tggccctgaaactcctcact

SEQ ID NO: 1196 - DNA, 21 bp, Homo sapiens
tgcaaccagttctgggagaga

SEQ ID NO: 1197 - DNA, 20 bp, Homo sapiens
cacccaacaccccaatctgt

SEQ ID NO: 1198 - DNA, 20 bp, Homo sapiens
ggctccctgcggtatctctt

SEQ ID NO: 1199 - DNA, 24 bp, Homo sapiens
agtccattcctgattcagaacacc

SEQ ID NO: 1200 - DNA, 19 bp, Homo sapiens
gtgaccttgccagctccag

SEQ ID NO: 1201 - DNA, 19 bp, Homo sapiens
aggggccttgaagacgatg

SEQ ID NO: 1202 - DNA, 20 bp, Homo sapiens
agtggtcgttgagggcaatg

SEQ ID NO: 1203 - DNA, 20 bp, Homo sapiens
aggggagaagctgggacaag

SEQ ID NO: 1204 - DNA, 21 bp, Homo sapiens
cctcctcttcctcctcgactg

SEQ ID NO: 1205 - DNA, 21 bp, Homo sapiens
tccatcaggagcttcttgctc

SEQ ID NO: 1206 - DNA, 20 bp, Homo sapiens
agtggcagaggaggcaggtt

SEQ ID NO: 1207 - DNA, 22 bp, Homo sapiens
actgccaaatgaaagcgaattt

SEQ ID NO: 1208 - DNA, 20 bp, Homo sapiens
ctggggtctggaagcagtgt

SEQ ID NO: 1209 - DNA, 20 bp, Homo sapiens
agtgtgacggcactgagctg

SEQ ID NO: 1210 - DNA, 19 bp, Homo sapiens
ccctgtagacggcatggaa

SEQ ID NO: 1211 - DNA, 22 bp, Homo sapiens
catgatttcatctcgctcaagg

SEQ ID NO: 1212 - DNA, 20 bp, Homo sapiens
ggctctttcgcagctgttct

SEQ ID NO: 1213 - DNA, 20 bp, Homo sapiens
gacagtggagcagccaacac

SEQ ID NO: 1214 - DNA, 22 bp, Homo sapiens
cctgccaagtgttttcatcaca

SEQ ID NO: 1215 - DNA, 19 bp, Homo sapiens
ccccttcccaaggagcttt

SEQ ID NO: 1216 - DNA, 21 bp, Homo sapiens
accccacacctctacctcagc

SEQ ID NO: 1217 - DNA, 20 bp, Homo sapiens
gttgggtaacgccagggttt

SEQ ID NO: 1218 - DNA, 20 bp, Homo sapiens
cgcaccaaaagttgtgcgta

SEQ ID NO: 1219 - DNA, 20 bp, Homo sapiens
tccgggctagtaggtgatgg

SEQ ID NO: 1220 - DNA, 20 bp, Homo sapiens
ttttccccttttcccagtcc

SEQ ID NO: 1221 - DNA, 20 bp, Homo sapiens
catcagggccaattggaaag

SEQ ID NO: 1222 - DNA, 20 bp, Homo sapiens
atggggacggtaacgactca

SEQ ID NO: 1223 - DNA, 20 bp, Homo sapiens
gtcatttctggcacgggaag

SEQ ID NO: 1224 - DNA, 20 bp, Homo sapiens
ggggagtgtggtgatggagt

SEQ ID NO: 1225 - DNA, 20 bp, Homo sapiens
agccctgggtcttcaggaac

SEQ ID NO: 1226 - DNA, 20 bp, Homo sapiens
ctggggtaggggagaggtgt

SEQ ID NO: 1227 - DNA, 21 bp, Homo sapiens
gaaagggaagcaggctcaagt

SEQ ID NO: 1228 - DNA, 21 bp, Homo sapiens
tcatgtggcgatcttgacctt

SEQ ID NO: 1229 - DNA, 21 bp, Homo sapiens
ccatgatgaggaaggttgagc

SEQ ID NO: 1230 - DNA, 25 bp, Homo sapiens
ttgagggagtagtggaatgaaaaca

SEQ ID NO: 1231 - DNA, 20 bp, Homo sapiens
acactcaggcctggagaagg

SEQ ID NO: 1232 - DNA, 20 bp, Homo sapiens
tttcgaagcccttggagatg

SEQ ID NO: 1233 - DNA, 20 bp, Homo sapiens
tgctgcaccctcttcatcag

SEQ ID NO: 1234 - DNA, 20 bp, Homo sapiens
ggcaagcacaacccacagat

SEQ ID NO: 1235 - DNA, 20 bp, Homo sapiens
tccttgtcgatctccgggta

SEQ ID NO: 1236 - DNA, 20 bp, Homo sapiens
gttgtcctcctccggcttct

SEQ ID NO: 1237 - DNA, 20 bp, Homo sapiens
ggccaggagggtatgtcctt

SEQ ID NO: 1238 - DNA, 20 bp, Homo sapiens
ccctttcaatccagcaagca

SEQ ID NO: 1239 - DNA, 20 bp, Homo sapiens
cagagggccctgtctctgaa

SEQ ID NO: 1240 - DNA, 20 bp, Homo sapiens
tcatcccatagtggggaagc

SEQ ID NO: 1241 - DNA, 20 bp, Homo sapiens
ttaacacccggaagggtgaa

SEQ ID NO: 1242 - DNA, 20 bp, Homo sapiens
gactggagccatgaggtcgt

SEQ ID NO: 1243 - DNA, 20 bp, Homo sapiens
gctgctgcctcgactttctc

SEQ ID NO: 1244 - DNA, 20 bp, Homo sapiens
ccagaggaagggtgtgctct

SEQ ID NO: 1245 - DNA, 25 bp, Homo sapiens
ttaagccctaagtgatactgcctca

SEQ ID NO: 1246 - DNA, 25 bp, Homo sapiens
ttaggaattgatgctggttagtgct

SEQ ID NO: 1247 - DNA, 20 bp, Homo sapiens
gcggccgtcattaattcaaa

SEQ ID NO: 1248 - DNA, 20 bp, Homo sapiens
atttgccttcagccacatcc

SEQ ID NO: 1249 - DNA, 20 bp, Homo sapiens
ggtggttcgccttgaactga

SEQ ID NO: 1250 - DNA, 20 bp, Homo sapiens
atcaggtgaccgctttggaa

SEQ ID NO: 1251 - DNA, 20 bp, Homo sapiens
gcacaggaacacggtctgaa

SEQ ID NO: 1252 - DNA, 20 bp, Homo sapiens
aggggtggaatgaggcaaat

SEQ ID NO: 1253 - DNA, 20 bp, Homo sapiens
ccacagctgtcgctgtcttc

SEQ ID NO: 1254 - DNA, 32 bp, Homo sapiens
aaatacaaaacaaattcacaaattactctcaa

SEQ ID NO: 1255 - DNA, 25 bp, Homo sapiens
ttggcattagactcacatcatctgt

SEQ ID NO: 1256 - DNA, 25 bp, Homo sapiens
aaaccagacaaacgaataacacaca

SEQ ID NO: 1257 - DNA, 26 bp, Homo sapiens
aggattatatcaacagcgatgaactg

SEQ ID NO: 1258 - DNA, 19 bp, Homo sapiens
ccgagcccgataaatggta

SEQ ID NO: 1259 - DNA, 20 bp, Homo sapiens
tcccctccctgtagagacca

SEQ ID NO: 1260 - DNA, 20 bp, Homo sapiens
catcctctcaagggcatggt

SEQ ID NO: 1261 - DNA, 21 bp, Homo sapiens
tcccacattcctgacattggt

SEQ ID NO: 1262 - DNA, 20 bp, Homo sapiens
cacagccctgaacaaaagca

SEQ ID NO: 1263 - DNA, 20 bp, Homo sapiens
gctatttcaggtggggctga

SEQ ID NO: 1264 - DNA, 21 bp, Homo sapiens
aatccaggccaaatgggtaaa

SEQ ID NO: 1265 - DNA, 20 bp, Homo sapiens
aaaggctccagggctcctaa

SEQ ID NO: 1266 - DNA, 20 bp, Homo sapiens
tccatgtccaagccttccat

SEQ ID NO: 1267 - DNA, 20 bp, Homo sapiens
atgcaaatccagggtgcagt

SEQ ID NO: 1268 - DNA, 20 bp, Homo sapiens
caggagtcaaagggcacgat

SEQ ID NO: 1269 - DNA, 20 bp, Homo sapiens
cacgcattgcacttttcctc

SEQ ID NO: 1270 - DNA, 27 bp, Homo sapiens
acaaatctgtacccaatcgttattgtt

SEQ ID NO: 1271 - DNA, 23 bp, Homo sapiens
tcaacattgacaaagcaggatca

SEQ ID NO: 1272 - DNA, 20 bp, Homo sapiens
cccacaccgtacatgcctct

SEQ ID NO: 1273 - DNA, 23 bp, Homo sapiens
tggcactctttccagtgactgtt

SEQ ID NO: 1274 - DNA, 20 bp, Homo sapiens
agcctccctcccttagcgta

SEQ ID NO: 1275 - DNA, 20 bp, Homo sapiens
atgcccaggtaggaccctgt

SEQ ID NO: 1276 - DNA, 20 bp, Homo sapiens
cctcacattccctccccatt

SEQ ID NO: 1277 - DNA, 20 bp, Homo sapiens
ctgggcagggcttattcctt

SEQ ID NO: 1278 - DNA, 20 bp, Homo sapiens
aaggctgcattctgggtttg

SEQ ID NO: 1279 - DNA, 20 bp, Homo sapiens
gccatgctacccggtatgac

SEQ ID NO: 1280 - DNA, 24 bp, Homo sapiens
tgatttaaaatagggctgggaaaa

SEQ ID NO: 1281 - DNA, 20 bp, Homo sapiens
cgatgtcatgtgatgcacga

SEQ ID NO: 1282 - DNA, 23 bp, Homo sapiens
gcaaagaagagcttaagcaccag

SEQ ID NO: 1283 - DNA, 20 bp, Homo sapiens
cgtaaggcacagctgcaaaa

SEQ ID NO: 1284 - DNA, 20 bp, Homo sapiens
gtggaacaccctgacgaagg

SEQ ID NO: 1285 - DNA, 23 bp, Homo sapiens
tgcctgacagtaagtgctcaaaa

SEQ ID NO: 1286 - DNA, 27 bp, Homo sapiens
aaattctttgcttgttagtgaccttga

SEQ ID NO: 1287 - DNA, 23 bp, Homo sapiens
cttggctcagtatgcaacctttt

SEQ ID NO: 1288 - DNA, 20 bp, Homo sapiens
acacctgtgcctgggagaag

SEQ ID NO: 1289 - DNA, 20 bp, Homo sapiens
gttctctctctggccgatgc

SEQ ID NO: 1290 - DNA, 24 bp, Homo sapiens
tgtttctaacccataagtgcctca

SEQ ID NO: 1291 - DNA, 20 bp, Homo sapiens
aaagcccacagccaagtcag

SEQ ID NO: 1292 - DNA, 20 bp, Homo sapiens
cacagctccgatgaccacaa

SEQ ID NO: 1293 - DNA, 20 bp, Homo sapiens
ggtccttgtagacccgacga

SEQ ID NO: 1294 - DNA, 20 bp, Homo sapiens
agcaggaaatgcctgtgctc

SEQ ID NO: 1295 - DNA, 20 bp, Homo sapiens
tcagttcgtgggaccctttc

SEQ ID NO: 1296 - DNA, 20 bp, Homo sapiens
gggccttaaaactgccaagg

SEQ ID NO: 1297 - DNA, 20 bp, Homo sapiens
gcctgagcgagaggatgttc

SEQ ID NO: 1298 - DNA, 20 bp, Homo sapiens
gaaggcgttgaacgagatgg

SEQ ID NO: 1299 - DNA, 28 bp, Homo sapiens
tcccaatctaatttaaaccctcataaca

SEQ ID NO: 1300 - DNA, 20 bp, Homo sapiens
agcttcccagccctagcaaa

SEQ ID NO: 1301 - DNA, 20 bp, Homo sapiens
ccaaggaggttgggaagagg

SEQ ID NO: 1302 - DNA, 20 bp, Homo sapiens
tcatgtgcacgaggaagctc

SEQ ID NO: 1303 - DNA, 20 bp, Homo sapiens
ttgcaaagcctttcacagga

SEQ ID NO: 1304 - DNA, 20 bp, Homo sapiens
accagcacagaacccaaagc

SEQ ID NO: 1305 - DNA, 20 bp, Homo sapiens
gggagcgtatctcaggcaga

SEQ ID NO: 1306 - DNA, 20 bp, Homo sapiens
cacccatacaggacgcacag

SEQ ID NO: 1307 - DNA, 20 bp, Homo sapiens
gaatcccggccactgatgta

SEQ ID NO: 1308 - DNA, 20 bp, Homo sapiens
taacatttgcttcggcatgg

SEQ ID NO: 1309 - DNA, 20 bp, Homo sapiens
tcccaactgcaaaccctcat

SEQ ID NO: 1310 - DNA, 20 bp, Homo sapiens
ttgagctggtgggtgcatta

SEQ ID NO: 1311 - DNA, 20 bp, Homo sapiens
cgctgtattctcgccagtga

SEQ ID NO: 1312 - DNA, 20 bp, Homo sapiens
caacacgcacatctgggaac

SEQ ID NO: 1313 - DNA, 19 bp, Homo sapiens
aagcatttccgcacactgg

SEQ ID NO: 1314 - DNA, 20 bp, Homo sapiens
acgacgtccaccttttcctg

SEQ ID NO: 1315 - DNA, 20 bp, Homo sapiens
ttgcatgagaagcacctcca

SEQ ID NO: 1316 - DNA, 27 bp, Homo sapiens
tcagaaagctttgactactgtttctcc

SEQ ID NO: 1317 - DNA, 20 bp, Homo sapiens
atggctgccaagatggaaag

SEQ ID NO: 1318 - DNA, 20 bp, Homo sapiens
ggcaaccctagccacacact

SEQ ID NO: 1319 - DNA, 20 bp, Homo sapiens
cacagagaaggaggccttgc

SEQ ID NO: 1320 - DNA, 20 bp, Homo sapiens
gccagctccagatggacatt

SEQ ID NO: 1321 - DNA, 20 bp, Homo sapiens
cgtgtgttgcatcgtgtctg

SEQ ID NO: 1322 - DNA, 20 bp, Homo sapiens
cgctttggggcatctaattg

SEQ ID NO: 1323 - DNA, 20 bp, Homo sapiens
cgctcagctttggcttcttc

SEQ ID NO: 1324 - DNA, 20 bp, Homo sapiens
gaggtctgcttgcacccact

SEQ ID NO: 1325 - DNA, 20 bp, Homo sapiens
cagaccctgtgtggcagtgt

SEQ ID NO: 1326 - DNA, 20 bp, Homo sapiens
cacattgggcactgctgaaa

SEQ ID NO: 1327 - DNA, 21 bp, Homo sapiens
tgatggggatcggggattgca

SEQ ID NO: 1328 - DNA, 32 bp, Homo sapiens
tcctgtaacaatgcatctcatatttggaatga

SEQ ID NO: 1329 - DNA, 20 bp, Homo sapiens
cgtccagcctgggtcggggt

SEQ ID NO: 1330 - DNA, 32 bp, Homo sapiens
tgaactcttcaatctcttgcactcaaagcttg

SEQ ID NO: 1331 - DNA, 35 bp, Homo sapiens
ccaatcaaggtataacacacaaatgttatctgcgc

SEQ ID NO: 1332 - DNA, 20 bp, Homo sapiens
tgccattcccgctggcttgg

SEQ ID NO: 1333 - DNA, 21 bp, Homo sapiens
ggccgtccaccacagcatggt

SEQ ID NO: 1334 - DNA, 27 bp, Homo sapiens
tgccctgatttgaagggaaaagggatg

SEQ ID NO: 1335 - DNA, 23 bp, Homo sapiens
ggacggcgacagaaattgcaggc

SEQ ID NO: 1336 - DNA, 20 bp, Homo sapiens
ccctgactcccccgtcccca

SEQ ID NO: 1337 - DNA, 30 bp, Homo sapiens
gggcgtacactttcccttctcaatctctca

SEQ ID NO: 1338 - DNA, 30 bp, Homo sapiens
tcacagcattggcattatctgagatggtga

SEQ ID NO: 1339 - DNA, 34 bp, Homo sapiens
aaggtttcaacctaatggagggatgagaagatca

SEQ ID NO: 1340 - DNA, 30 bp, Homo sapiens
gggtcctatgctactgttgcactctccaca

SEQ ID NO: 1341 - DNA, 26 bp, Homo sapiens
ggcagactccttgccaacgggtattg

SEQ ID NO: 1342 - DNA, 28 bp, Homo sapiens
ccaatccatgaggatggtgaaatgatgg

SEQ ID NO: 1343 - DNA, 27 bp, Homo sapiens
ggccaagaaagcattttcacctcctgc

SEQ ID NO: 1344 - DNA, 22 bp, Homo sapiens
tcccaacaagccccctgcagaa

SEQ ID NO: 1345 - DNA, 25 bp, Homo sapiens
tgaaagccaaaggctccagtcacca

SEQ ID NO: 1346 - DNA, 24 bp, Homo sapiens
ggttttcccatttgtggagggcga

SEQ ID NO: 1347 - DNA, 28 bp, Homo sapiens
ccagcctcagaggaagaggatttttcgg

SEQ ID NO: 1348 - DNA, 24 bp, Homo sapiens
gcagtgccgcacttggagatttgg

SEQ ID NO: 1349 - DNA, 32 bp, Homo sapiens
gtgttatacgatgaacatgccacatgctttca

SEQ ID NO: 1350 - DNA, 20 bp, Homo sapiens
cctgggccaccccagcacac

SEQ ID NO: 1351 - DNA, 29 bp, Homo sapiens
tgcaaatggttacttccagataacggcca

SEQ ID NO: 1352 - DNA, 22 bp, Homo sapiens
gcctgtcctcaaggctgctgcc

SEQ ID NO: 1353 - DNA, 22 bp, Homo sapiens
tccactgagccctgctgcctca

SEQ ID NO: 1354 - DNA, 20 bp, Homo sapiens
tgggctccctgggagtcccc

SEQ ID NO: 1355 - DNA, 20 bp, Homo sapiens
agcccagacccaggcctgcc

SEQ ID NO: 1356 - DNA, 22 bp, Homo sapiens
ccgccacagtgtcgtggtggtc

SEQ ID NO: 1357 - DNA, 20 bp, Homo sapiens
gcaggccacccagcacaccc

SEQ ID NO: 1358 - DNA, 20 bp, Homo sapiens
tcaccctgggggccctcctg

SEQ ID NO: 1359 - DNA, 23 bp, Homo sapiens
ggccaaaggaagtgacccctcgg

SEQ ID NO: 1360 - DNA, 20 bp, Homo sapiens
tctccagggcctccgcacca

SEQ ID NO: 1361 - DNA, 20 bp, Homo sapiens
accaccttggagccgtgcgc

SEQ ID NO: 1362 - DNA, 34 bp, Homo sapiens
ccaactactaaactgggggatattatgaagggcc

SEQ ID NO: 1363 - DNA, 34 bp, Homo sapiens
cctggactgtttcctgataaccataagaagaccc

SEQ ID NO: 1364 - DNA, 25 bp, Homo sapiens
tgggtccaggggtaaacaacgagga

SEQ ID NO: 1365 - DNA, 20 bp, Homo sapiens
tggggttgcccatgatggca

SEQ ID NO: 1366 - DNA, 20 bp, Homo sapiens
tgtccagcgacgcctgcagc

SEQ ID NO: 1367 - DNA, 22 bp, Homo sapiens
cagccgctcctcaagcactggg

SEQ ID NO: 1368 - DNA, 23 bp, Homo sapiens
ggccctcaaccaccacaacctgc

SEQ ID NO: 1369 - DNA, 26 bp, Homo sapiens
gccctctcacagtggaatggagagca

SEQ ID NO: 1370 - DNA, 20 bp, Homo sapiens
caaccaggccaggtgggcca

SEQ ID NO: 1371 - DNA, 29 bp, Homo sapiens
tggtccggggtgcattatctctacagtca

SEQ ID NO: 1372 - DNA, 25 bp, Homo sapiens
cctccggaattcattccagtcaccg

SEQ ID NO: 1373 - DNA, 29 bp, Homo sapiens
tgttcagtctgaagtttgccagtttggcc

SEQ ID NO: 1374 - DNA, 20 bp, Homo sapiens
cccacgcacaagggagccca

SEQ ID NO: 1375 - DNA, 26 bp, Homo sapiens
tgtccctccctccttcagagagtggg

SEQ ID NO: 1376 - DNA, 22 bp, Homo sapiens
gcgattactcagggcccggctg

SEQ ID NO: 1377 - DNA, 20 bp, Homo sapiens
cccccggggcacaaggaaga

SEQ ID NO: 1378 - DNA, 20 bp, Homo sapiens
tcccagggtgggcacatggg

SEQ ID NO: 1379 - DNA, 20 bp, Homo sapiens
cagtggggcagtggggtccg

SEQ ID NO: 1380 - DNA, 32 bp, Homo sapiens
tgacctaacttcaggagcgtctgtgagacatg

SEQ ID NO: 1381 - DNA, 29 bp, Homo sapiens
tgacccaaacatcataccccaatagtgca

SEQ ID NO: 1382 - DNA, 29 bp, Homo sapiens
tttattcctcccaactaccactggcgctt

SEQ ID NO: 1383 - DNA, 27 bp, Homo sapiens
tgcttttaagttttggccaactgccga

SEQ ID NO: 1384 - DNA, 22 bp, Homo sapiens
tgggggaggtgcaaccttctgc

SEQ ID NO: 1385 - DNA, 20 bp, Homo sapiens
gcctcccccagggggcttgt

SEQ ID NO: 1386 - DNA, 27 bp, Homo sapiens
tggatcgggattggaatcccttaagca

SEQ ID NO: 1387 - DNA, 27 bp, Homo sapiens
ccattatggggaccttcacctgcttca

SEQ ID NO: 1388 - DNA, 20 bp, Homo sapiens
atgcccatgtgcaagggcgc

SEQ ID NO: 1389 - DNA, 32 bp, Homo sapiens
catccatttctcttcttcaggaagatcgtgga

SEQ ID NO: 1390 - DNA, 20 bp, Homo sapiens
tcccaccatggctgtggccc

SEQ ID NO: 1391 - DNA, 26 bp, Homo sapiens
ggagcttcctttcacacacaggcctg

SEQ ID NO: 1392 - DNA, 21 bp, Homo sapiens
tcaggagacctgggcccagca

SEQ ID NO: 1393 - DNA, 23 bp, Homo sapiens
ttcgacctgagcctgcggagaga

SEQ ID NO: 1394 - DNA, 31 bp, Homo sapiens
ggaaacaaaactggcagtttgtccatttgaa

SEQ ID NO: 1395 - DNA, 20 bp, Homo sapiens
tggagggggcagcgtgctgt

SEQ ID NO: 1396 - DNA, 20 bp, Homo sapiens
ccgagcgcgcgaatctccag

SEQ ID NO: 1397 - DNA, 20 bp, Homo sapiens
aggtgggccggtcctctggg

SEQ ID NO: 1398 - DNA, 26 bp, Homo sapiens
aacaccttacaagggcggagaagcca

SEQ ID NO: 1399 - DNA, 22 bp, Homo sapiens
tgggccctcgttgcatttggtg

SEQ ID NO: 1400 - DNA, 35 bp, Homo sapiens
tgggtagtgtttcaggcatattttgaatacatcga

SEQ ID NO: 1401 - DNA, 32 bp, Homo sapiens
tcattattccgtaattcaacacagcactacca

SEQ ID NO: 1402 - DNA, 31 bp, Homo sapiens
tgtacactggataaagaaaaccatgaaacgc

SEQ ID NO: 1403 - DNA, 29 bp, Homo sapiens
ccatcccttaaatcctcaggtcacaacca

SEQ ID NO: 1404 - DNA, 22 bp, Homo sapiens
tcccttcaccttcgctgccaca

SEQ ID NO: 1405 - DNA, 22 bp, Homo sapiens
aaccccatctggtcagtgcggc

SEQ ID NO: 1406 - DNA, 20 bp, Homo sapiens
cgctgcctgggtgcgactgc

SEQ ID NO: 1407 - DNA, 24 bp, Homo sapiens
ccccaacggtgacaaacacactca

SEQ ID NO: 1408 - DNA, 24 bp, Homo sapiens
tgccatggacagaagaaggcagca

SEQ ID NO: 1409 - DNA, 24 bp, Homo sapiens
cacagccctggcctctgctcaact

SEQ ID NO: 1410 - DNA, 28 bp, Homo sapiens
tccatacagcactgctggaggaagagga

SEQ ID NO: 1411 - DNA, 32 bp, Homo sapiens
caagatcccaaaatccaaactgattgactgag

SEQ ID NO: 1412 - DNA, 24 bp, Homo sapiens
tgcactgtgacaagctgcacgtgg

SEQ ID NO: 1413 - DNA, 28 bp, Homo sapiens
tcctctttggccacaagaataagcagca

SEQ ID NO: 1414 - DNA, 26 bp, Homo sapiens
ccaccaaagaactgtcagcagctgcc

SEQ ID NO: 1415 - DNA, 34 bp, Homo sapiens
tcctcagtcaagttcagagtcttcagagacttcg

SEQ ID NO: 1416 - DNA, 26 bp, Homo sapiens
caaaggcaattcccacaaaagctggc

SEQ ID NO: 1417 - DNA, 24 bp, Homo sapiens
aaaacagctggagagtcccagccg

SEQ ID NO: 1418 - DNA, 20 bp, Homo sapiens
acattgacatgggtgggttt

SEQ ID NO: 1419 - DNA, 31 bp, Homo sapiens
tccttgtgattggtggtgaaactttctttgc

SEQ ID NO: 1420 - DNA, 31 bp, Homo sapiens
tgctgtgtaacaagttagggtggacttgctg

SEQ ID NO: 1421 - DNA, 32 bp, Homo sapiens
tgagaaaaattcaaaagaatcgaaaggttgca

SEQ ID NO: 1422 - DNA, 31 bp, Homo sapiens
ccagcatttctataccactttgggctttggt

SEQ ID NO: 1423 - DNA, 29 bp, Homo sapiens
tggaaaatgtgcaatatgtgatgtggcaa

SEQ ID NO: 1424 - DNA, 26 bp, Homo sapiens
tgcaagggctctgtgacaaggaagga

SEQ ID NO: 1425 - DNA, 22 bp, Homo sapiens
cggcaaatgtagcatgggcacc

SEQ ID NO: 1426 - DNA, 33 bp, Homo sapiens
tggattaccttttgtcaaagcatcatctcaaca

SEQ ID NO: 1427 - DNA, 27 bp, Homo sapiens
ccctccatcatcgacactggtctagcc

SEQ ID NO: 1428 - DNA, 21 bp, Homo sapiens
tggcaggggtggctgcctcat

SEQ ID NO: 1429 - DNA, 20 bp, Homo sapiens
tcatgggtttggctgccccg

SEQ ID NO: 1430 - DNA, 25 bp, Homo sapiens
cccctatggggatggtccactgtca

SEQ ID NO: 1431 - DNA, 32 bp, Homo sapiens
ggcaagagactggactgagactttgtgagaaa

SEQ ID NO: 1432 - DNA, 32 bp, Homo sapiens
ccgtgtgaaccaaacaatctcttttcaaaaca

SEQ ID NO: 1433 - DNA, 27 bp, Homo sapiens
catctgcagccagttagtgccacctga

SEQ ID NO: 1434 - DNA, 28 bp, Homo sapiens
gctgatgatttagagtgctgtccggtgg

SEQ ID NO: 1435 - DNA, 20 bp, Homo sapiens
cccaaattctttcagtggct

SEQ ID NO: 1436 - DNA, 26 bp, Homo sapiens
caaggcaccacacaacccagaaagga

SEQ ID NO: 1437 - DNA, 31 bp, Homo sapiens
cactcggcatttaaaatgtgctgtcaaaaca

SEQ ID NO: 1438 - DNA, 26 bp, Homo sapiens
gggattcccctaacctcattccccaa

SEQ ID NO: 1439 - DNA, 31 bp, Homo sapiens
tgtgtcaggtgaccctgatgaaaacatagca

SEQ ID NO: 1440 - DNA, 22 bp, Homo sapiens
gcccttggcctgaagtcccagc

SEQ ID NO: 1441 - DNA, 25 bp, Homo sapiens
caagcctcattcccaacctgcacct

SEQ ID NO: 1442 - DNA, 20 bp, Homo sapiens
tgctggggctccccatttgc

SEQ ID NO: 1443 - DNA, 24 bp, Homo sapiens
caaggcatggcgtagagggtgctg

SEQ ID NO: 1444 - DNA, 20 bp, Homo sapiens
acaaccccctcctcggcccc

SEQ ID NO: 1445 - DNA, 34 bp, Homo sapiens
caggggtaactccagaaaggattgatatctgtga

SEQ ID NO: 1446 - DNA, 34 bp, Homo sapiens
tgccttacaagaaagacataaaatgtccaaggga

SEQ ID NO: 1447 - DNA, 20 bp, Homo sapiens
ccactggggttcaggcccca

SEQ ID NO: 1448 - DNA, 20 bp, Homo sapiens
ctggcctcgcgctgctgctt

SEQ ID NO: 1449 - DNA, 29 bp, Homo sapiens
ctcaaacctgaaatcagaagagggccatg

SEQ ID NO: 1450 - DNA, 20 bp, Homo sapiens
gcagcccctcgtgctgcaca

SEQ ID NO: 1451 - DNA, 28 bp, Homo sapiens
tcccgtgggatactatttcagacgtgca

SEQ ID NO: 1452 - DNA, 29 bp, Homo sapiens
tcctgtacctgctcccaatctgtgttcct

SEQ ID NO: 1453 - DNA, 28 bp, Homo sapiens
acgaagcatccacagatccctcaaaaca

SEQ ID NO: 1454 - DNA, 20 bp, Homo sapiens
cccggatgaacgccgctcct

SEQ ID NO: 1455 - DNA, 22 bp, Homo sapiens
ccggctcgaggacgtggaggat

SEQ ID NO: 1456 - DNA, 20 bp, Homo sapiens
tcgtgatggcctggccctgc

SEQ ID NO: 1457 - DNA, 20 bp, Homo sapiens
gcctgggaacaagggggcca

SEQ ID NO: 1458 - DNA, 23 bp, Homo sapiens
tcaggtggtcaatggccagcacc

SEQ ID NO: 1459 - DNA, 25 bp, Homo sapiens
tggcttggatttggggttacagcca

SEQ ID NO: 1460 - DNA, 34 bp, Homo sapiens
gaaaatgcacaaactgtcaaaattcatcatcgtg

SEQ ID NO: 1461 - DNA, 21 bp, Homo sapiens
tcctgggtgggtgcagcctca

SEQ ID NO: 1462 - DNA, 22 bp, Homo sapiens
gggactgcagttgtggctgcca

SEQ ID NO: 1463 - DNA, 25 bp, Homo sapiens
tcttggcatacggagcagagctgga

SEQ ID NO: 1464 - DNA, 25 bp, Homo sapiens
gggggcctgttggcttttccttttc

SEQ ID NO: 1465 - DNA, 29 bp, Homo sapiens
ggcagtgtcataggcagtatcctgcacag

SEQ ID NO: 1466 - DNA, 20 bp, Homo sapiens
gaggggaccctctggcccga

SEQ ID NO: 1467 - DNA, 34 bp, Homo sapiens
tggagggatatcaggtcatcattgtgtatcaaaa

SEQ ID NO: 1468 - DNA, 28 bp, Homo sapiens
tgtgtctgcgatggtcgtctcttactgg

SEQ ID NO: 1469 - DNA, 25 bp, Homo sapiens
gggttctcgttgcaatcctcggtca

SEQ ID NO: 1470 - DNA, 26 bp, Homo sapiens
gccatccacatctcccgcttatcctc

SEQ ID NO: 1471 - DNA, 20 bp, Homo sapiens
tcacccctgctttgccccca

SEQ ID NO: 1472 - DNA, 26 bp, Homo sapiens
tggaagccacccgattcttgtatcgc

SEQ ID NO: 1473 - DNA, 20 bp, Homo sapiens
gaggggaccctctggcccga

SEQ ID NO: 1474 - DNA, 19 bp, Homo sapiens
ccctggaccaacccggccc

SEQ ID NO: 1475 - DNA, 26 bp, Homo sapiens
gacggaagagaaattcactggcgcct

SEQ ID NO: 1476 - DNA, 27 bp, Homo sapiens
tcaaattcttggccatcctgaaagggc

SEQ ID NO: 1477 - DNA, 29 bp, Homo sapiens
cccaatctaaaggagcttctgccaaagga

SEQ ID NO: 1478 - DNA, 20 bp, Homo sapiens
cccatcccgctgccaggtca

SEQ ID NO: 1479 - DNA, 33 bp, Homo sapiens
cagtggccaattttcataccctaagaagaatga

SEQ ID NO: 1480 - DNA, 21 bp, Homo sapiens
cattggggagcagagggccca

SEQ ID NO: 1481 - DNA, 26 bp, Homo sapiens
ccacgttgcaaaatctgcaaatccca

SEQ ID NO: 1482 - DNA, 28 bp, Homo sapiens
gggttttgactgacgtgcattcctctga

SEQ ID NO: 1483 - DNA, 27 bp, Homo sapiens
tggaattgtccaagtcagcaccacagg

SEQ ID NO: 1484 - DNA, 23 bp, Homo sapiens
aggggtggtgatctggctgaggg

SEQ ID NO: 1485 - DNA, 33 bp, Homo sapiens
ccaaagtccatttactcgagacagaaatgagtc

SEQ ID NO: 1486 - DNA, 30 bp, Homo sapiens
gcgtccttcttcttcttgtcgtccttaggc

SEQ ID NO: 1487 - DNA, 26 bp, Homo sapiens
tgggtgtcgctgttgaagtcagagga

SEQ ID NO: 1488 - DNA, 25 bp, Homo sapiens
ccggctgctttaatgagggcattga

SEQ ID NO: 1489 - DNA, 26 bp, Homo sapiens
caaaggatgtgaggggaaaaaggggg

SEQ ID NO: 1490 - DNA, 20 bp, Homo sapiens
cctcccagcccaaagcccca

SEQ ID NO: 1491 - DNA, 22 bp, Homo sapiens
catgggggtgtggaggtgggag

SEQ ID NO: 1492 - DNA, 26 bp, Homo sapiens
gccttgtcattgggcacacaacaacc

SEQ ID NO: 1493 - DNA, 26 bp, Homo sapiens
ggaaaaccaggctctccaggaatggg

SEQ ID NO: 1494 - DNA, 32 bp, Homo sapiens
tcacgtgaggtagaggacagttttctgtgtca

SEQ ID NO: 1495 - DNA, 31 bp, Homo sapiens
ccccacccccttaatcagactttaaaagtgc

SEQ ID NO: 1496 - DNA, 20 bp, Homo sapiens
cgcgtctgccccgcgaacta

SEQ ID NO: 1497 - DNA, 22 bp, Homo sapiens
gccctctccagactggtgggca

SEQ ID NO: 1498 - DNA, 20 bp, Homo sapiens
tctggagggccaggtggggg

SEQ ID NO: 1499 - DNA, 20 bp, Homo sapiens
ccccagcaaatgccaggggc

SEQ ID NO: 1500 - DNA, 28 bp, Homo sapiens
ggccgttaatttaatggggccaactttg

SEQ ID NO: 1501 - DNA, 28 bp, Homo sapiens
gcagcccatggcatttttctttttacca

SEQ ID NO: 1502 - DNA, 23 bp, Homo sapiens
tggtgcctttgggatcgactggg

SEQ ID NO: 1503 - DNA, 33 bp, Homo sapiens
gctcatcagagtaggagagttgtagcaaaggca

SEQ ID NO: 1504 - DNA, 33 bp, Homo sapiens
aactcatcgtgatgatggaaacaagaatgatga

SEQ ID NO: 1505 - DNA, 21 bp, Homo sapiens
tgccccagcccttcccagaga

SEQ ID NO: 1506 - DNA, 26 bp, Homo sapiens
gggattgaacccttgccatgagttcc

SEQ ID NO: 1507 - DNA, 25 bp, Homo sapiens
gtctggagagaaggccttgctccca

SEQ ID NO: 1508 - DNA, 21 bp, Homo sapiens
ggggatgctggagggccttca

SEQ ID NO: 1509 - DNA, 34 bp, Homo sapiens
cagaagggcatggagggtacctacttattcttca

SEQ ID NO: 1510 - DNA, 20 bp, Homo sapiens
ctgcccagtgcacagcccca

SEQ ID NO: 1511 - DNA, 23 bp, Homo sapiens
ccagagctggacctgggacctgc

SEQ ID NO: 1512 - DNA, 20 bp, Homo sapiens
tcgggatgggtggacgtggg

SEQ ID NO: 1513 - DNA, 20 bp, Homo sapiens
gttccccaggtcccgccagc

SEQ ID NO: 1514 - DNA, 31 bp, Homo sapiens
tgattgctttggtgcttaacttgaagtggga

SEQ ID NO: 1515 - DNA, 20 bp, Homo sapiens
actggctggaacgtcggcgc

SEQ ID NO: 1516 - DNA, 24 bp, Homo sapiens
cgtggggtgtgttggagtgtggtg

SEQ ID NO: 1517 - DNA, 23 bp, Homo sapiens
ttgaccagaaacccagggcaggg

SEQ ID NO: 1518 - DNA, 20 bp, Homo sapiens
aatggagtgggctcgggcgc

SEQ ID NO: 1519 - DNA, 20 bp, Homo sapiens
acagctgaaacccgcggggc

SEQ ID NO: 1520 - DNA, 24 bp, Homo sapiens
tggccctccaactcttctttgcga

SEQ ID NO: 1521 - DNA, 28 bp, Homo sapiens
aaaccgatatccttcgcgtactgacgga

SEQ ID NO: 1522 - DNA, 23 bp, Homo sapiens
catgcactggacactggccctga

SEQ ID NO: 1523 - DNA, 20 bp, Homo sapiens
gaaggcgtcaaggccgcgtg

SEQ ID NO: 1524 - DNA, 25 bp, Homo sapiens
tcaagcaaatgaggctggagctgga

SEQ ID NO: 1525 - DNA, 35 bp, Homo sapiens
ccactgtatttcatttctgtgatgagttctgacca

SEQ ID NO: 1526 - DNA, 27 bp, Homo sapiens
gcctcaggtggagcagtgaggtagaca

SEQ ID NO: 1527 - DNA, 21 bp, Homo sapiens
tccggacaggcggctgtctca

SEQ ID NO: 1528 - DNA, 21 bp, Homo sapiens
ccatctctgtgccgtgcccca

SEQ ID NO: 1529 - DNA, 23 bp, Homo sapiens
tgctttgatgacacccaccgcaa

SEQ ID NO: 1530 - DNA, 34 bp, Homo sapiens
tttttcgtttaaagtagtcttccgtggttgggaa

SEQ ID NO: 1531 - DNA, 24 bp, Homo sapiens
tggaggagtgggtgtcgctgttga

SEQ ID NO: 1532 - DNA, 22 bp, Homo sapiens
cactgctcagcggtggaggtgg

SEQ ID NO: 1533 - DNA, 21 bp, Homo sapiens
caccggagcttgtggccagca

SEQ ID NO: 1534 - DNA, 26 bp, Homo sapiens
tcgcttttgctgggactttcaaagcc

SEQ ID NO: 1535 - DNA, 22 bp, Homo sapiens
tgcggacgttgagctctgtggc

SEQ ID NO: 1536 - DNA, 32 bp, Homo sapiens
gatgctagagaactggaaggataacttggggg

SEQ ID NO: 1537 - DNA, 22 bp, Homo sapiens
tgccatcttcctccttccggcc

SEQ ID NO: 1538 - DNA, 21 bp, Homo sapiens
gccctgttgtggctggctgca

SEQ ID NO: 1539 - DNA, 33 bp, Homo sapiens
ccctttatcagggagtacttgtggtagacgtcg

SEQ ID NO: 1540 - DNA, 23 bp, Homo sapiens
tcaaccggtcagagccagagccc

SEQ ID NO: 1541 - DNA, 32 bp, Homo sapiens
ttcagcatgttcacttgaagatccatcagatg

SEQ ID NO: 1542 - DNA, 28 bp, Homo sapiens
ccgtggtgattttatagcatcctgggca

SEQ ID NO: 1543 - DNA, 28 bp, Homo sapiens
cccaaggctaatcctagccatctcctgc

SEQ ID NO: 1544 - DNA, 32 bp, Homo sapiens
caagtggatgggaagtaaagccctatgtgtca

SEQ ID NO: 1545 - DNA, 20 bp, Homo sapiens
ctcaggcacctgcgtccccg

SEQ ID NO: 1546 - DNA, 25 bp, Homo sapiens
tcacgacgttgtaaaacgacggcca

SEQ ID NO: 1547 - DNA, 29 bp, Homo sapiens
tctaccgtcatggagcttctgtttccaca

SEQ ID NO: 1548 - DNA, 22 bp, Homo sapiens
tcgcccaggtagtggccgatca

SEQ ID NO: 1549 - DNA, 32 bp, Homo sapiens
ggaagtcttcttggttatcctggctttggaaa

SEQ ID NO: 1550 - DNA, 27 bp, Homo sapiens
ccacaagcctgaaaatgcaatgtcctg

SEQ ID NO: 1551 - DNA, 25 bp, Homo sapiens
tcctgtgccaaatcatctgcagcaa

SEQ ID NO: 1552 - DNA, 29 bp, Homo sapiens
tcaggatcaatgactgaaatttggccatg

SEQ ID NO: 1553 - DNA, 24 bp, Homo sapiens
ccagcaggggaactctggacaggc

SEQ ID NO: 1554 - DNA, 23 bp, Homo sapiens
ggaggggaaggaggcaatgtggg

SEQ ID NO: 1555 - DNA, 24 bp, Homo sapiens
gcctctcggaggagtcaaaggggc

SEQ ID NO: 1556 - DNA, 25 bp, Homo sapiens
cccagcacctggggaattctaagcc

SEQ ID NO: 1557 - DNA, 26 bp, Homo sapiens
gcttgatttgtggaccagtgtcccca

SEQ ID NO: 1558 - DNA, 33 bp, Homo sapiens
ccccctaaaatcccactgtaaacaaacatttcg

SEQ ID NO: 1559 - DNA, 36 bp, Homo sapiens
gacaaatgtttttacatgtggaatgtcacatcaacc

SEQ ID NO: 1560 - DNA, 20 bp, Homo sapiens
caccccacccccagcccatt

SEQ ID NO: 1561 - DNA, 23 bp, Homo sapiens
tgaaatgagaggtggcccgtggg

SEQ ID NO: 1562 - DNA, 22 bp, Homo sapiens
gcccatccgctcatggatgtcc

SEQ ID NO: 1563 - DNA, 31 bp, Homo sapiens
gaggtacacatttgaatgacaacaggggctc

SEQ ID NO: 1564 - DNA, 21 bp, Homo sapiens
ccacgatggccctgctggtca

SEQ ID NO: 1565 - DNA, 23 bp, Homo sapiens
cctccgcggcctctttgtttgaa

SEQ ID NO: 1566 - DNA, 25 bp, Homo sapiens
tgcttacactggcctgattggtggg

SEQ ID NO: 1567 - DNA, 36 bp, Homo sapiens
tcaggctctgatacctgcttttaaaatggagctaga

SEQ ID NO: 1568 - DNA, 20 bp, Homo sapiens
tctacccccaccccgacccg

SEQ ID NO: 1569 - DNA, 21 bp, Homo sapiens
ccccacccccaattcttggcc

SEQ ID NO: 1570 - DNA, 20 bp, Homo sapiens
ccagcgcccgctagcccact

SEQ ID NO: 1571 - DNA, 20 bp, Homo sapiens
gcgcatatgcggctgtgcca

SEQ ID NO: 1572 - DNA, 21 bp, Homo sapiens
cgtccaggacacagccagggc

SEQ ID NO: 1573 - DNA, 34 bp, Homo sapiens
cagtggtcattgtacagcacaagaatgaacaatg

SEQ ID NO: 1574 - DNA, 31 bp, Homo sapiens
gagcagagaccaaccttctcaaagttggtga

SEQ ID NO: 1575 - DNA, 28 bp, Homo sapiens
gccgtgagtttttgctcttactcccagg

SEQ ID NO: 1576 - DNA, 25 bp, Homo sapiens
cagggaggacaaactctgggctgga

SEQ ID NO: 1577 - DNA, 20 bp, Homo sapiens
cacccggttggtcccagccc

SEQ ID NO: 1578 - DNA, 20 bp, Homo sapiens
tggctgctgctgcctccgtg

SEQ ID NO: 1579 - DNA, 29 bp, Homo sapiens
ggccagggtctctggaagagaacttttca

SEQ ID NO: 1580 - DNA, 20 bp, Homo sapiens
ccgtcgctgtccacaggggc

SEQ ID NO: 1581 - DNA, 27 bp, Homo sapiens
cccgacaacaaaatgcctcaagtgagg

SEQ ID NO: 1582 - DNA, 20 bp, Homo sapiens
ggcccttggacggcatggct

SEQ ID NO: 1583 - DNA, 24 bp, Homo sapiens
cctgcagccagcactggtacagca

SEQ ID NO: 1584 - DNA, 30 bp, Homo sapiens
tgcaaatgtctttgcttgcttgtactcacg

SEQ ID NO: 1585 - DNA, 34 bp, Homo sapiens
tcagatttcacatgtatggctctgtcctactgct

SEQ ID NO: 1586 - DNA, 35 bp, Homo sapiens
ccagagcattttccattaaaccaattctttgatca

SEQ ID NO: 1587 - DNA, 27 bp, Homo sapiens
aacgtaatcatacctctagtcatagca

SEQ ID NO: 1588 - DNA, 27 bp, Homo sapiens
cagctcactgtgaaggcttgagcctca

SEQ ID NO: 1589 - DNA, 20 bp, Homo sapiens
cccttcccccgacctggggt

SEQ ID NO: 1590 - DNA, 26 bp, Homo sapiens
ggatttctccagcgcgtgagatctga

SEQ ID NO: 1591 - DNA, 23 bp, Homo sapiens
tggctttggtgccatgactgcct

SEQ ID NO: 1592 - DNA, 20 bp, Homo sapiens
tgggcacatcgtgaggggcc

SEQ ID NO: 1593 - DNA, 33 bp, Homo sapiens
ctgtgaatcaacagagcatgctaccacttcagt

SEQ ID NO: 1594 - DNA, 29 bp, Homo sapiens
tgagaaagtgaaattggggcttgtggaga

SEQ ID NO: 1595 - DNA, 24 bp, Homo sapiens
gtgggattggctcagttttgccca

SEQ ID NO: 1596 - DNA, 30 bp, Homo sapiens
gagctgagatgctgtgcaactgtttaaggg

SEQ ID NO: 1597 - DNA, 23 bp, Homo sapiens
gtggggtcagcaccatttgctgg

SEQ ID NO: 1598 - DNA, 20 bp, Homo sapiens
gccctggtggggtgacacgc

SEQ ID NO: 1599 - DNA, 34 bp, Homo sapiens
aacttgttttaccccctctcctcaacatcttgtc

SEQ ID NO: 1600 - DNA, 35 bp, Homo sapiens
tggacttcctttgtgattccttttcaatctcactc

SEQ ID NO: 1601 - DNA, 30 bp, Homo sapiens
gcctttttctttggaaatgcaactctgctg

SEQ ID NO: 1602 - DNA, 27 bp, Homo sapiens
tggacaaacggtcttgcacaaatgacg

SEQ ID NO: 1603 - DNA, 27 bp, Homo sapiens
ccaaggtcacctagcctgctttttgcc

SEQ ID NO: 1604 - DNA, 23 bp, Homo sapiens
ttcccaggctgcctctcctcacc

SEQ ID NO: 1605 - DNA, 23 bp, Homo sapiens
tcctgggcccagtctcacactgg

SEQ ID NO: 1606 - DNA, 28 bp, Homo sapiens
agcttctttgcacatgtaaagcaggcca

SEQ ID NO: 1607 - DNA, 22 bp, Homo sapiens
tgggagcagaggttcagcccca

SEQ ID NO: 1608 - DNA, 27 bp, Homo sapiens
tgaggacagactgtggacaccccatct

SEQ ID NO: 1609 - DNA, 26 bp, Homo sapiens
ctgtaagcccccttttggatgccaaa

SEQ ID NO: 1610 - DNA, 24 bp, Homo sapiens
ttcccctggtgctgaatgtggaca

SEQ ID NO: 1611 - DNA, 34 bp, Homo sapiens
tcatcaacaacaaacatgcagtttctttctctga

SEQ ID NO: 1612 - DNA, 31 bp, Homo sapiens
ttgattgcaaatggaggtacagtttctgcct

SEQ ID NO: 1613 - DNA, 20 bp, Homo sapiens
cgcaacaacaagcgcacgca

SEQ ID NO: 1614 - DNA, 32 bp, Homo sapiens
tccaggaagaatttcatgtttagagctgctgc

SEQ ID NO: 1615 - DNA, 33 bp, Homo sapiens
cgatagttgggcatctgtatttccacttgtgtg

SEQ ID NO: 1616 - DNA, 32 bp, Homo sapiens
agaggggaaaacctattctacccaacacagca

SEQ ID NO: 1617 - DNA, 22 bp, Homo sapiens
tgggcaacttggggaagcccct

SEQ ID NO: 1618 - DNA, 23 bp, Homo sapiens
aagcgcttgactatgtggcccgg

SEQ ID NO: 1619 - DNA, 32 bp, Homo sapiens
tcagaaaagaaaagctctttagactagcaatg

SEQ ID NO: 1620 - DNA, 27 bp, Homo sapiens
tcacaacctcggagagaagatggaccc

SEQ ID NO: 1621 - DNA, 22 bp, Homo sapiens
aggccagcaacaatgcccacga

SEQ ID NO: 1622 - DNA, 19 bp, Homo sapiens
tggggtgccactcgacgcg

SEQ ID NO: 1623 - DNA, 22 bp, Homo sapiens
cgaagctggagctgggagctcg

SEQ ID NO: 1624 - DNA, 20 bp, Homo sapiens
acccggctgcgcaggtctga

SEQ ID NO: 1625 - DNA, 33 bp, Homo sapiens
ggatttttaaggggatccctatttatggccaaa

SEQ ID NO: 1626 - DNA, 20 bp, Homo sapiens
ccaggacccgatcgcgatcg

SEQ ID NO: 1627 - DNA, 24 bp, Homo sapiens
aggctctgctcgttccctctcccc

SEQ ID NO: 1628 - DNA, 21 bp, Homo sapiens
tgcgggcgcaagcttatgtcc

SEQ ID NO: 1629 - DNA, 29 bp, Homo sapiens
tttgctggcttatgatgtgtaaggcacca

SEQ ID NO: 1630 - DNA, 19 bp, Homo sapiens
cgggggcctgaggccagtg

SEQ ID NO: 1631 - DNA, 34 bp, Homo sapiens
cctctttgctgtttttcacctactacgtcacaca

SEQ ID NO: 1632 - DNA, 29 bp, Homo sapiens
agaggctgaagctcctcagcttccaactc

SEQ ID NO: 1633 - DNA, 34 bp, Homo sapiens
tgctctccaacacctttgtttagtagggaaaacc

SEQ ID NO: 1634 - DNA, 28 bp, Homo sapiens
ggaaaagctcaagaaggctgggagatga

SEQ ID NO: 1635 - DNA, 23 bp, Homo sapiens
ggatggacgcggacggaattctg

SEQ ID NO: 1636 - DNA, 21 bp, Homo sapiens
aggaccaaggcccagccagca

SEQ ID NO: 1637 - DNA, 31 bp, Homo sapiens
tcctcctcacttccctacctcacaacaagaa

SEQ ID NO: 1638 - DNA, 29 bp, Homo sapiens
tgacaacagagaccaaaaacaaccaccca

SEQ ID NO: 1639 - DNA, 26 bp, Homo sapiens
tgccgagaggaattgtaaggttgcca

SEQ ID NO: 1640 - DNA, 30 bp, Homo sapiens
cagaacctcacagacccaaaggaacatcaa

SEQ ID NO: 1641 - DNA, 33 bp, Homo sapiens
tggagttgaaaaacagatcaagtcagggacatc

SEQ ID NO: 1642 - DNA, 34 bp, Homo sapiens
tgtccagaatctagtttgtgcagaaatgtttcca

SEQ ID NO: 1643 - DNA, 22 bp, Homo sapiens
cacagcctcggtagcagcggga

SEQ ID NO: 1644 - DNA, 23 bp, Homo sapiens
gttggcctttagggctgtgccca

SEQ ID NO: 1645 - DNA, 29 bp, Homo sapiens
ccagcccacaatttcaaataatgcaggaa

SEQ ID NO: 1646 - DNA, 29 bp, Homo sapiens
aatgcacttcatgaaaagttgtggctccc

SEQ ID NO: 1647 - DNA, 28 bp, Homo sapiens
gcgccaaagagtatcaggaaagcaagga

SEQ ID NO: 1648 - DNA, 27 bp, Homo sapiens
tgccacttcattggcacctaagacctg

SEQ ID NO: 1649 - DNA, 20 bp, Homo sapiens
cccctgtggcatccctggca

SEQ ID NO: 1650 - DNA, 19 bp, Homo sapiens
cgccgcccttgtgctgctc

SEQ ID NO: 1651 - DNA, 35 bp, Homo sapiens
gcagggaaagggggttagttattcatttttcagct

SEQ ID NO: 1652 - DNA, 35 bp, Homo sapiens
caactgctccacttctttttgtttgagaactctga

SEQ ID NO: 1653 - DNA, 28 bp, Homo sapiens
ggcagctgggagatgatggtaaaaggct

SEQ ID NO: 1654 - DNA, 35 bp, Homo sapiens
ccaaagagcaaagctacacaaagaaaattcctcag

SEQ ID NO: 1655 - DNA, 25 bp, Homo sapiens
cacacaggcatgtgtgtctgcatgg

SEQ ID NO: 1656 - DNA, 20 bp, Homo sapiens
aagtgcagcgttccttttgc

SEQ ID NO: 1657 - DNA, 20 bp, Homo sapiens
ccggggtgacaagcagatac

SEQ ID NO: 1658 - DNA, 20 bp, Homo sapiens
aaggaagcctcctccacgtt

SEQ ID NO: 1659 - DNA, 20 bp, Homo sapiens
cagaagcaaggggctgaaaa

SEQ ID NO: 1660 - DNA, 20 bp, Homo sapiens
caacccacccctccttcttt

SEQ ID NO: 1661 - DNA, 22 bp, Homo sapiens
tcagggaatgaaggtgtcagaa

SEQ ID NO: 1662 - DNA, 22 bp, Homo sapiens
tggctgagttctggtcaaagaa

SEQ ID NO: 1663 - DNA, 22 bp, Homo sapiens
tctgtccatcatttcaccatcc

SEQ ID NO: 1664 - DNA, 20 bp, Homo sapiens
ctcggtgggtgttcaaggag

SEQ ID NO: 1665 - DNA, 20 bp, Homo sapiens
tgctccttttggtgactgga

SEQ ID NO: 1666 - DNA, 20 bp, Homo sapiens
ggcctggttagaggctggtt

SEQ ID NO: 1667 - DNA, 20 bp, Homo sapiens
ctgtctctgcctccctcacc

SEQ ID NO: 1668 - DNA, 20 bp, Homo sapiens
ggagaagcggcgataccata

SEQ ID NO: 1669 - DNA, 20 bp, Homo sapiens
gtcccacctgggagaatgtg

SEQ ID NO: 1670 - DNA, 20 bp, Homo sapiens
tcactcccagttccctggac

SEQ ID NO: 1671 - DNA, 20 bp, Homo sapiens
atccgccacaacctgagtct

SEQ ID NO: 1672 - DNA, 20 bp, Homo sapiens
gtgtcctccctcccctatgc

SEQ ID NO: 1673 - DNA, 20 bp, Homo sapiens
ctgggccgtgactacaggac

SEQ ID NO: 1674 - DNA, 20 bp, Homo sapiens
tcgtgcaatggagattctgg

SEQ ID NO: 1675 - DNA, 20 bp, Homo sapiens
ctaagccactgcctgctggt

SEQ ID NO: 1676 - DNA, 20 bp, Homo sapiens
atgtgggccaagatctccac

SEQ ID NO: 1677 - DNA, 22 bp, Homo sapiens
gcccttcataatatcccccagt

SEQ ID NO: 1678 - DNA, 21 bp, Homo sapiens
ggcattgtgttcccaagttca

SEQ ID NO: 1679 - DNA, 19 bp, Homo sapiens
cgtctccctctgccatcct

SEQ ID NO: 1680 - DNA, 20 bp, Homo sapiens
gggaaggctcctggttgtct

SEQ ID NO: 1681 - DNA, 20 bp, Homo sapiens
acagaggccctggaaaggac

SEQ ID NO: 1682 - DNA, 21 bp, Homo sapiens
tacctgacctttgtgccctca

SEQ ID NO: 1683 - DNA, 20 bp, Homo sapiens
aagtccggtggtttcggaat

SEQ ID NO: 1684 - DNA, 20 bp, Homo sapiens
ggaatggagagcacggtctg

SEQ ID NO: 1685 - DNA, 20 bp, Homo sapiens
tttgcacaggtgttccctga

SEQ ID NO: 1686 - DNA, 26 bp, Homo sapiens
tttgaatgaccaagttctcttcattg

SEQ ID NO: 1687 - DNA, 20 bp, Homo sapiens
cacctttgcctttgctggac

SEQ ID NO: 1688 - DNA, 20 bp, Homo sapiens
ctcccttgtgcgtgggtaag

SEQ ID NO: 1689 - DNA, 20 bp, Homo sapiens
cttctccctctgcccctctc

SEQ ID NO: 1690 - DNA, 20 bp, Homo sapiens
gggagagggacatcctacgg

SEQ ID NO: 1691 - DNA, 20 bp, Homo sapiens
ccagcctggaggtgatcaag

SEQ ID NO: 1692 - DNA, 20 bp, Homo sapiens
aagatgggtctccgcacttg

SEQ ID NO: 1693 - DNA, 20 bp, Homo sapiens
gccagtggtagttgggagga

SEQ ID NO: 1694 - DNA, 26 bp, Homo sapiens
gccaataaagaaattaacacccaaaa

SEQ ID NO: 1695 - DNA, 20 bp, Homo sapiens
acccttccatggtgtgatcg

SEQ ID NO: 1696 - DNA, 20 bp, Homo sapiens
acctcacagggaccctccac

SEQ ID NO: 1697 - DNA, 24 bp, Homo sapiens
ctggacaagcttacatcttcctca

SEQ ID NO: 1698 - DNA, 20 bp, Homo sapiens
atccgtgacgacatgctgtg

SEQ ID NO: 1699 - DNA, 20 bp, Homo sapiens
gatgccaccttcagcctctg

SEQ ID NO: 1700 - DNA, 20 bp, Homo sapiens
ccacctggaatcagggattg

SEQ ID NO: 1701 - DNA, 20 bp, Homo sapiens
tcatcttggagggaccaagg

SEQ ID NO: 1702 - DNA, 19 bp, Homo sapiens
ggacatttgccttgctgga

SEQ ID NO: 1703 - DNA, 20 bp, Homo sapiens
gggcccagcagttctatgac

SEQ ID NO: 1704 - DNA, 20 bp, Homo sapiens
cctgccttgtgacaggatga

SEQ ID NO: 1705 - DNA, 21 bp, Homo sapiens
ggcaactggtgaacggtaaca

SEQ ID NO: 1706 - DNA, 20 bp, Homo sapiens
cccaaggctaagcaggaggt

SEQ ID NO: 1707 - DNA, 20 bp, Homo sapiens
gggtcccaaacaactcagga

SEQ ID NO: 1708 - DNA, 20 bp, Homo sapiens
cccaagtcaggctggagaga

SEQ ID NO: 1709 - DNA, 22 bp, Homo sapiens
aacaattcaagtgctgggcttt

SEQ ID NO: 1710 - DNA, 20 bp, Homo sapiens
cggtggctaccagacattga

SEQ ID NO: 1711 - DNA, 21 bp, Homo sapiens
cagcagtttcaatgcaccaaa

SEQ ID NO: 1712 - DNA, 26 bp, Homo sapiens
gacaactttcgcatttgcttttattt

SEQ ID NO: 1713 - DNA, 25 bp, Homo sapiens
gctttaatggcatgtcagacagaac

SEQ ID NO: 1714 - DNA, 21 bp, Homo sapiens
agtcccagcattgatgacagc

SEQ ID NO: 1715 - DNA, 20 bp, Homo sapiens
cctgtttgccatcctcttgg

SEQ ID NO: 1716 - DNA, 20 bp, Homo sapiens
caccggctaatggtgggtaa

SEQ ID NO: 1717 - DNA, 20 bp, Homo sapiens
gtcgcccagtcctaccagag

SEQ ID NO: 1718 - DNA, 25 bp, Homo sapiens
attccgttagacttgtcctcctttt

SEQ ID NO: 1719 - DNA, 20 bp, Homo sapiens
gacgaccatcgcagacacag

SEQ ID NO: 1720 - DNA, 19 bp, Homo sapiens
ctgggagacccgctgtttc

SEQ ID NO: 1721 - DNA, 24 bp, Homo sapiens
tgggctaactatgcagagcatgta

SEQ ID NO: 1722 - DNA, 20 bp, Homo sapiens
cgacaatgagcggggagata

SEQ ID NO: 1723 - DNA, 20 bp, Homo sapiens
accactgctgctgctgtttg

SEQ ID NO: 1724 - DNA, 20 bp, Homo sapiens
ccctgaaggtgaaccgctta

SEQ ID NO: 1725 - DNA, 25 bp, Homo sapiens
gtcaaacagattaaggttcgagtgg

SEQ ID NO: 1726 - DNA, 20 bp, Homo sapiens
gcctgaggctgtgaagatgg

SEQ ID NO: 1727 - DNA, 21 bp, Homo sapiens
aggaggcataggccatttcag

SEQ ID NO: 1728 - DNA, 20 bp, Homo sapiens
gaggaccagacccaggacac

SEQ ID NO: 1729 - DNA, 20 bp, Homo sapiens
gcttgtgcatgaccctgatg

SEQ ID NO: 1730 - DNA, 19 bp, Homo sapiens
caggagaacgtggccctct

SEQ ID NO: 1731 - DNA, 20 bp, Homo sapiens
tgcctgtccttctgtgtgct

SEQ ID NO: 1732 - DNA, 22 bp, Homo sapiens
gaggaatgcacgtcagtcaaaa

SEQ ID NO: 1733 - DNA, 19 bp, Homo sapiens
gcaaggctgacgagagctg

SEQ ID NO: 1734 - DNA, 20 bp, Homo sapiens
ccatccgggatatcctagcc

SEQ ID NO: 1735 - DNA, 20 bp, Homo sapiens
ccctgtctctccccaccttt

SEQ ID NO: 1736 - DNA, 18 bp, Homo sapiens
gacgaggctgcggtgtct

SEQ ID NO: 1737 - DNA, 19 bp, Homo sapiens
gggaaactgtggcgtgatg

SEQ ID NO: 1738 - DNA, 21 bp, Homo sapiens
cagccggtgtaaatgttgagc

SEQ ID NO: 1739 - DNA, 19 bp, Homo sapiens
ttaaaattccgggccttgg

SEQ ID NO: 1740 - DNA, 21 bp, Homo sapiens
gtgcatccgtggtcaaaagtc

SEQ ID NO: 1741 - DNA, 19 bp, Homo sapiens
tcctgtccatgtgcctggt

SEQ ID NO: 1742 - DNA, 20 bp, Homo sapiens
gcagcagtcagcgatgtttc

SEQ ID NO: 1743 - DNA, 21 bp, Homo sapiens
ccaaacctgcaaacaaacagg

SEQ ID NO: 1744 - DNA, 26 bp, Homo sapiens
tgccaatgatgtacagttttatggtt

SEQ ID NO: 1745 - DNA, 22 bp, Homo sapiens
agccatttctccaatggacatc

SEQ ID NO: 1746 - DNA, 21 bp, Homo sapiens
attcatgtccagtggcttcca

SEQ ID NO: 1747 - DNA, 19 bp, Homo sapiens
actccctgcccaccagtct

SEQ ID NO: 1748 - DNA, 20 bp, Homo sapiens
aaggagctgcccgatgctat

SEQ ID NO: 1749 - DNA, 20 bp, Homo sapiens
gccatactccctgcctcctt

SEQ ID NO: 1750 - DNA, 21 bp, Homo sapiens
ttgacaccaccctctttggaa

SEQ ID NO: 1751 - DNA, 22 bp, Homo sapiens
ctccaaccatgaaatcaaagca

SEQ ID NO: 1752 - DNA, 21 bp, Homo sapiens
gaaatcaaagcacggtgcaga

SEQ ID NO: 1753 - DNA, 20 bp, Homo sapiens
ccccgatgctcagaagtgtc

SEQ ID NO: 1754 - DNA, 21 bp, Homo sapiens
ggggacaacgaaaacaagagg

SEQ ID NO: 1755 - DNA, 20 bp, Homo sapiens
ccgctatgatcctcgctttg

SEQ ID NO: 1756 - DNA, 22 bp, Homo sapiens
ggagaagatcctttggatgcag

SEQ ID NO: 1757 - DNA, 20 bp, Homo sapiens
caagccaaaatgggagcaag

SEQ ID NO: 1758 - DNA, 19 bp, Homo sapiens
ctggccgtcatggagactg

SEQ ID NO: 1759 - DNA, 20 bp, Homo sapiens
agtcctgcaactgcctcctg

SEQ ID NO: 1760 - DNA, 20 bp, Homo sapiens
tggcctcagggaaaagactg

SEQ ID NO: 1761 - DNA, 20 bp, Homo sapiens
tccctggtagacggggtagg

SEQ ID NO: 1762 - DNA, 20 bp, Homo sapiens
gcggaaaagtcaggggaaac

SEQ ID NO: 1763 - DNA, 22 bp, Homo sapiens
tccaggatcaaaacattcctca

SEQ ID NO: 1764 - DNA, 20 bp, Homo sapiens
cagacgcagagcatggatga

SEQ ID NO: 1765 - DNA, 20 bp, Homo sapiens
cccgtaagcgctaattccag

SEQ ID NO: 1766 - DNA, 25 bp, Homo sapiens
catgctgaaacaagattaacacagg

SEQ ID NO: 1767 - DNA, 20 bp, Homo sapiens
ttgcgcctaatcatgtcgtc

SEQ ID NO: 1768 - DNA, 19 bp, Homo sapiens
gaagcacaggtccgtgtcg

SEQ ID NO: 1769 - DNA, 20 bp, Homo sapiens
gcagaaaaccgttgcattga

SEQ ID NO: 1770 - DNA, 20 bp, Homo sapiens
cgccagtgtttccgtcagta

SEQ ID NO: 1771 - DNA, 32 bp, Homo sapiens
atacaaataatcttacacacaaatgaaaatgc

SEQ ID NO: 1772 - DNA, 21 bp, Homo sapiens
ccgtctcgtagataggcagca

SEQ ID NO: 1773 - DNA, 20 bp, Homo sapiens
gctccagcctcatttgcttg

SEQ ID NO: 1774 - DNA, 23 bp, Homo sapiens
ttttaattggggtgatccaaagc

SEQ ID NO: 1775 - DNA, 20 bp, Homo sapiens
aagcctcaggtggagcagtg

SEQ ID NO: 1776 - DNA, 20 bp, Homo sapiens
gcctgtccggagactgaaga

SEQ ID NO: 1777 - DNA, 19 bp, Homo sapiens
cggcacagagatggagctg

SEQ ID NO: 1778 - DNA, 19 bp, Homo sapiens
tccacctttgggtcgcttt

SEQ ID NO: 1779 - DNA, 19 bp, Homo sapiens
tcccaccaaaccccagact

SEQ ID NO: 1780 - DNA, 20 bp, Homo sapiens
gccctcaacgaccactttgt

SEQ ID NO: 1781 - DNA, 20 bp, Homo sapiens
accgctgagcagtgaccttc

SEQ ID NO: 1782 - DNA, 20 bp, Homo sapiens
cacaagctccggtggatctc

SEQ ID NO: 1783 - DNA, 20 bp, Homo sapiens
accccagcccctagacagag

SEQ ID NO: 1784 - DNA, 20 bp, Homo sapiens
aacctgcctcctctgccact

SEQ ID NO: 1785 - DNA, 24 bp, Homo sapiens
gtgaaagggtactggataccaacc

SEQ ID NO: 1786 - DNA, 20 bp, Homo sapiens
cgaatggcctctagccacac

SEQ ID NO: 1787 - DNA, 20 bp, Homo sapiens
cacaacagggctgcaacaaa

SEQ ID NO: 1788 - DNA, 23 bp, Homo sapiens
gacgtctggttcaaagagttgga

SEQ ID NO: 1789 - DNA, 19 bp, Homo sapiens
tggctctgaccggttgatg

SEQ ID NO: 1790 - DNA, 19 bp, Homo sapiens
gcgaccaccagcagctcta

SEQ ID NO: 1791 - DNA, 19 bp, Homo sapiens
tgtgaaatgcccaggatgc

SEQ ID NO: 1792 - DNA, 22 bp, Homo sapiens
gcccttgacagggtatttctga

SEQ ID NO: 1793 - DNA, 25 bp, Homo sapiens
cgtgtcagaaaacaaagcatactga

SEQ ID NO: 1794 - DNA, 19 bp, Homo sapiens
ggggagctctccctgacct

SEQ ID NO: 1795 - DNA, 20 bp, Homo sapiens
acaattcactggccgtcgtt

SEQ ID NO: 1796 - DNA, 20 bp, Homo sapiens
ggagaatgcagaggccaaaa

SEQ ID NO: 1797 - DNA, 20 bp, Homo sapiens
cgagatgatcggccactacc

SEQ ID NO: 1798 - DNA, 20 bp, Homo sapiens
aagcaggggactgggaaaag

SEQ ID NO: 1799 - DNA, 20 bp, Homo sapiens
ttgcattttcaggcttgtgg

SEQ ID NO: 1800 - DNA, 20 bp, Homo sapiens
ctcgcctaagagggcctttc

SEQ ID NO: 1801 - DNA, 20 bp, Homo sapiens
gcggggacaccccttaatag

SEQ ID NO: 1802 - DNA, 20 bp, Homo sapiens
taagcaacagccccaaatgc

SEQ ID NO: 1803 - DNA, 20 bp, Homo sapiens
ggggagtgggtttggatagg

SEQ ID NO: 1804 - DNA, 20 bp, Homo sapiens
gcctcctcaaacggttcctt

SEQ ID NO: 1805 - DNA, 31 bp, Homo sapiens
cttttattaatatattgtgtgtgcaccttgt

SEQ ID NO: 1806 - DNA, 21 bp, Homo sapiens
tccacaaatcaagctcccaag

SEQ ID NO: 1807 - DNA, 32 bp, Homo sapiens
aggacgttctttattatgaaactttatcacat

SEQ ID NO: 1808 - DNA, 25 bp, Homo sapiens
ttaaatgtcaaaatgaaaggggaca

SEQ ID NO: 1809 - DNA, 21 bp, Homo sapiens
ccttctccaggcctgagtgtt

SEQ ID NO: 1810 - DNA, 21 bp, Homo sapiens
gaggcctctgatgaccagaca

SEQ ID NO: 1811 - DNA, 20 bp, Homo sapiens
gctccctgttgggtgtcatc

SEQ ID NO: 1812 - DNA, 19 bp, Homo sapiens
gtgggttgtgcttgccaga

SEQ ID NO: 1813 - DNA, 20 bp, Homo sapiens
tacccggagatcgacaagga

SEQ ID NO: 1814 - DNA, 20 bp, Homo sapiens
cggaatggtgaaaccaaagc

SEQ ID NO: 1815 - DNA, 20 bp, Homo sapiens
acataccctcctggcccttg

SEQ ID NO: 1816 - DNA, 20 bp, Homo sapiens
acctgaccgtgcgaatcaat

SEQ ID NO: 1817 - DNA, 20 bp, Homo sapiens
ctcttgccccgagcctagtt

SEQ ID NO: 1818 - DNA, 20 bp, Homo sapiens
ccccactatgggatgacgag

SEQ ID NO: 1819 - DNA, 21 bp, Homo sapiens
cagagctcttttggggtctgg

SEQ ID NO: 1820 - DNA, 19 bp, Homo sapiens
caccatctcctgcgtctcg

SEQ ID NO: 1821 - DNA, 20 bp, Homo sapiens
ttggcacaccagtgttctcc

SEQ ID NO: 1822 - DNA, 21 bp, Homo sapiens
gcccattgttcattcttgtgc

SEQ ID NO: 1823 - DNA, 26 bp, Homo sapiens
ccaagacaagaaattgttttgagaaa

SEQ ID NO: 1824 - DNA, 31 bp, Homo sapiens; identical to SEQ ID NO: 915

SEQ ID NO: 1825 - DNA, 19 bp, Homo sapiens
ccctcggtctgggcaataa

SEQ ID NO: 1826 - DNA, 20 bp, Homo sapiens
ccgggtgagatccacaagtc

SEQ ID NO: 1827 - DNA, 20 bp, Homo sapiens
gagccgcagatgcaagttct

SEQ ID NO: 1828 - DNA, 23 bp, Homo sapiens
gggctcctaaataccaagcttca

SEQ ID NO: 1829 - DNA, 20 bp, Homo sapiens
tcagcacctcagtcgtccac

SEQ ID NO: 1830 - DNA, 22 bp, Homo sapiens
cacttgaggcattttgttgtcg

SEQ ID NO: 1831 - DNA, 20 bp, Homo sapiens
agccctggtggcctattacc

SEQ ID NO: 1832 - DNA, 31 bp, Homo sapiens
tgtttgagtacattctttcaacactacacat

SEQ ID NO: 1833 - DNA, 29 bp, Homo sapiens
ttttaagtggaaatgtaaccattttagga

SEQ ID NO: 1834 - DNA, 22 bp, Homo sapiens
tagcctccccaagagagaacag

SEQ ID NO: 1835 - DNA, 21 bp, Homo sapiens
ccgcccgtaattaaatagcat

SEQ ID NO: 1836 - DNA, 21 bp, Homo sapiens
agggagcttgaagagggaatg

SEQ ID NO: 1837 - DNA, 20 bp, Homo sapiens
aaaatgttcgcctggctgat

SEQ ID NO: 1838 - DNA, 20 bp, Homo sapiens
tcccaccaatgtcaggaatg

SEQ ID NO: 1839 - DNA, 21 bp, Homo sapiens
gctctgagagttcccctgtcc

SEQ ID NO: 1840 - DNA, 20 bp, Homo sapiens
tttgcctgacatcgtctcgt

SEQ ID NO: 1841 - DNA, 20 bp, Homo sapiens
ttgggccaataaggattcca

SEQ ID NO: 1842 - DNA, 20 bp, Homo sapiens
gcagatgagcgtcccacttt

SEQ ID NO: 1843 - DNA, 20 bp, Homo sapiens
aatggaaggcttggacatgg

SEQ ID NO: 1844 - DNA, 23 bp, Homo sapiens
aaaagtgtccattgaaaccgtga

SEQ ID NO: 1845 - DNA, 20 bp, Homo sapiens
tgccttggagaggatggaag

SEQ ID NO: 1846 - DNA, 20 bp, Homo sapiens
tgccaggcttaaggagagga

SEQ ID NO: 1847 - DNA, 28 bp, Homo sapiens
ctaatgatattgatttggatacggtgaa

SEQ ID NO: 1848 - DNA, 20 bp, Homo sapiens
cccctcagatcccaatttca

SEQ ID NO: 1849 - DNA, 20 bp, Homo sapiens
gctgtgggatctcagtgtgc

SEQ ID NO: 1850 - DNA, 27 bp, Homo sapiens
acttgttaacctttctaaccttcacga

SEQ ID NO: 1851 - DNA, 20 bp, Homo sapiens
ggaagatgagcaggccagtg

SEQ ID NO: 1852 - DNA, 20 bp, Homo sapiens
tgtgcctctgccatcttcac

SEQ ID NO: 1853 - DNA, 21 bp, Homo sapiens
ttgaagctcttggcattcagc

SEQ ID NO: 1854 - DNA, 23 bp, Homo sapiens
gcagccaagaagatgtgaaagag

SEQ ID NO: 1855 - DNA, 20 bp, Homo sapiens
ggatgctgcaaacccagaat

SEQ ID NO: 1856 - DNA, 20 bp, Homo sapiens
cccgtggactgcttcaattc

SEQ ID NO: 1857 - DNA, 27 bp, Homo sapiens
ccatgttatgatctaaatgcttgttca

SEQ ID NO: 1858 - DNA, 20 bp, Homo sapiens
ttgagaaatggccccaactg

SEQ ID NO: 1859 - DNA, 21 bp, Homo sapiens
gggaacatgattggtctgctg

SEQ ID NO: 1860 - DNA, 20 bp, Homo sapiens
gcctcttccacttggtctgc

SEQ ID NO: 1861 - DNA, 20 bp, Homo sapiens
cccttcttcagcgaacgagt

SEQ ID NO: 1862 - DNA, 25 bp, Homo sapiens
tttcacacaggagatctcagacaga

SEQ ID NO: 1863 - DNA, 27 bp, Homo sapiens
taaccaaaatttaaaggcaaattcaca

SEQ ID NO: 1864 - DNA, 21 bp, Homo sapiens
caagccaaagtggcatgtttt

SEQ ID NO: 1865 - DNA, 21 bp, Homo sapiens
tcgtgctctccaacctgtctt

SEQ ID NO: 1866 - DNA, 20 bp, Homo sapiens
cctcgtgacatggacacacc

SEQ ID NO: 1867 - DNA, 23 bp, Homo sapiens
ttttttcaagcagtaaaattcca

SEQ ID NO: 1868 - DNA, 20 bp, Homo sapiens
gtggcctttcttgggtcctc

SEQ ID NO: 1869 - DNA, 20 bp, Homo sapiens
gcctggctgtcctagcagtt

SEQ ID NO: 1870 - DNA, 19 bp, Homo sapiens
gtacaagccgtccgacacg

SEQ ID NO: 1871 - DNA, 20 bp, Homo sapiens
gaccgaggactcaacccaaa

SEQ ID NO: 1872 - DNA, 20 bp, Homo sapiens
gcggaagaacatcgacctca

SEQ ID NO: 1873 - DNA, 21 bp, Homo sapiens
tggcagttttaaggcccaaac

SEQ ID NO: 1874 - DNA, 19 bp, Homo sapiens
acaagaccggcaccctcac

SEQ ID NO: 1875 - DNA, 20 bp, Homo sapiens
aagaatggggagagggaacg

SEQ ID NO: 1876 - DNA, 35 bp, Homo sapiens
ggagaaaactttattctttatagtttcaaatacca

SEQ ID NO: 1877 - DNA, 21 bp, Homo sapiens
ggctgggaagctctaccaaaa

SEQ ID NO: 1878 - DNA, 20 bp, Homo sapiens
ggagctcagcacctcttcca

SEQ ID NO: 1879 - DNA, 20 bp, Homo sapiens
cacccagctcctttcctgtg

SEQ ID NO: 1880 - DNA, 20 bp, Homo sapiens
ccctggggccctatttcata

SEQ ID NO: 1881 - DNA, 20 bp, Homo sapiens
ctccaggtagcccacggata

SEQ ID NO: 1882 - DNA, 20 bp, Homo sapiens
ctggcatctgcaccacaact

SEQ ID NO: 1883 - DNA, 20 bp, Homo sapiens
tcctccaggtgtggctgagt

SEQ ID NO: 1884 - DNA, 21 bp, Homo sapiens
cgggattcacactcagaacca

SEQ ID NO: 1885 - DNA, 19 bp, Homo sapiens
aagccatgccgaagcaaat

SEQ ID NO: 1886 - DNA, 21 bp, Homo sapiens
catgagatgtgtgggtggttg

SEQ ID NO: 1887 - DNA, 20 bp, Homo sapiens
ctctggtgccctcactctgc

SEQ ID NO: 1888 - DNA, 21 bp, Homo sapiens
tgttcctttgggtctgtgagg

SEQ ID NO: 1889 - DNA, 20 bp, Homo sapiens
ctgggccaatggtacaggtc

SEQ ID NO: 1890 - DNA, 23 bp, Homo sapiens
acaatcaaccaacaatggaaacc

SEQ ID NO: 1891 - DNA, 20 bp, Homo sapiens
gggctcctaccaggaaaagg

SEQ ID NO: 1892 - DNA, 20 bp, Homo sapiens
atgggcaagtgtcgtggact

SEQ ID NO: 1893 - DNA, 28 bp, Homo sapiens
ttttcttccttacgtcaatacttttcct

SEQ ID NO: 1894 - DNA, 25 bp, Homo sapiens
catgaaaacccagtaagactttcca

SEQ ID NO: 1895 - DNA, 20 bp, Homo sapiens
gaagtcctgggcatgcatct

SEQ ID NO: 1896 - DNA, 21 bp, Homo sapiens
gtgggcctgtgaagttttcaa

SEQ ID NO: 1897 - DNA, 20 bp, Homo sapiens
agcccttgacccttgagtcc

SEQ ID NO: 1898 - DNA, 20 bp, Homo sapiens
ggggacacagcagaagaacg

SEQ ID NO: 1899 - DNA, 20 bp, Homo sapiens
atcaccaaccgcaccttcat

SEQ ID NO: 1900 - DNA, 20 bp, Homo sapiens
tggggcaccatttcagtgta

SEQ ID NO: 1901 - DNA, 21 bp, Homo sapiens
cctttgcagcctgtttctgtc

SEQ ID NO: 1902 - DNA, 24 bp, Homo sapiens
gggtgtgtctgctcagtaatttga

SEQ ID NO: 1903 - DNA, 20 bp, Homo sapiens
agccatcggaagagaacagc

SEQ ID NO: 1904 - DNA, 20 bp, Homo sapiens
gaagggacacgcaggtggta

SEQ ID NO: 1905 - DNA, 24 bp, Homo sapiens
tgacttttaattccccaatcaagg

SEQ ID NO: 1906 - DNA, 21 bp, Homo sapiens
ccgtctgtgcatccatattcc

SEQ ID NO: 1907 - DNA, 20 bp, Homo sapiens
atgatccccacgatccatgt

SEQ ID NO: 1908 - DNA, 20 bp, Homo sapiens
gcacctggagaacccattca

SEQ ID NO: 1909 - DNA, 20 bp, Homo sapiens
tttcccttcgttgcttcctg

SEQ ID NO: 1910 - DNA, 20 bp, Homo sapiens
tccttgccaacgggtattgt

SEQ ID NO: 1911 - DNA, 21 bp, Homo sapiens
gccaaaccattcattgtcacc

SEQ ID NO: 1912 - DNA, 20 bp, Homo sapiens
tgtggcttttggaatgtgga

SEQ ID NO: 1913 - DNA, 20 bp, Homo sapiens
ggagggtgaatcccttgctc

SEQ ID NO: 1914 - DNA, 21 bp, Homo sapiens
aggctgtctggtcagcactgt

SEQ ID NO: 1915 - DNA, 20 bp, Homo sapiens
ccacagaagaggcagctggt

SEQ ID NO: 1916 - DNA, 23 bp, Homo sapiens
gagagcagcgtatcctgaagcta

SEQ ID NO: 1917 - DNA, 20 bp, Homo sapiens
ggggatccatgagtctcagc

SEQ ID NO: 1918 - DNA, 20 bp, Homo sapiens
gtgaggtctggggtgcttgt

SEQ ID NO: 1919 - DNA, 20 bp, Homo sapiens
cttgcggaactccagctcat

SEQ ID NO: 1920 - DNA, 20 bp, Homo sapiens
attggaatggccctctcctc

SEQ ID NO: 1921 - DNA, 20 bp, Homo sapiens
tcgcagcattggaaacactt

SEQ ID NO: 1922 - DNA, 20 bp, Homo sapiens
cacgagggtctccgcattta

SEQ ID NO: 1923 - DNA, 21 bp, Homo sapiens
gtgctcacagaagccaggaac

SEQ ID NO: 1924 - DNA, 20 bp, Homo sapiens
cgaagtgcgggaagtaggtc

SEQ ID NO: 1925 - DNA, 18 bp, Homo sapiens
ggtggctggtgtggctaa

SEQ ID NO: 1926 - DNA, 20 bp, Homo sapiens
agaaggtggtggctggtgtg

SEQ ID NO: 1927 - DNA, 20 bp, Homo sapiens
gggcttgaggttgtccatgt

SEQ ID NO: 1928 - DNA, 20 bp, Homo sapiens
gtgccttgactttggggttg

SEQ ID NO: 1929 - DNA, 20 bp, Homo sapiens
tgggctctgacttgtgagga

SEQ ID NO: 1930 - DNA, 20 bp, Homo sapiens
cgttgtctcaggcatctgga

SEQ ID NO: 1931 - DNA, 20 bp, Homo sapiens
tggggagtcatttccagcat

SEQ ID NO: 1932 - DNA, 18 bp, Homo sapiens
ggccccaaggaagagcag

SEQ ID NO: 1933 - DNA, 19 bp, Homo sapiens
ggcacagcttggacaacca

SEQ ID NO: 1934 - DNA, 20 bp, Homo sapiens
atatggtccggggtgcatta

SEQ ID NO: 1935 - DNA, 20 bp, Homo sapiens
cctgttgaatgcctccaggt

SEQ ID NO: 1936 - DNA, 21 bp, Homo sapiens
tgctgctgtgtttccctctct

SEQ ID NO: 1937 - DNA, 20 bp, Homo sapiens
tacacgtgggttgcgtcagt

SEQ ID NO: 1938 - DNA, 20 bp, Homo sapiens
cacttctgccctcccaacac

SEQ ID NO: 1939 - DNA, 20 bp, Homo sapiens
gcttgcaggtccaagcaaat

SEQ ID NO: 1940 - DNA, 20 bp, Homo sapiens
gcccctgattcaacaagcat

SEQ ID NO: 1941 - DNA, 26 bp, Homo sapiens
tcatacaatcactgaagacacacaca

SEQ ID NO: 1942 - DNA, 21 bp, Homo sapiens
ggcataatccaaagggttgct

SEQ ID NO: 1943 - DNA, 21 bp, Homo sapiens
cagctggaaaagggtgtagca

SEQ ID NO: 1944 - DNA, 20 bp, Homo sapiens
aggtacagggccagcaggat

SEQ ID NO: 1945 - DNA, 20 bp, Homo sapiens
gatttggatcgggattggaa

SEQ ID NO: 1946 - DNA, 20 bp, Homo sapiens
gtgccattcaccttgcacac

SEQ ID NO: 1947 - DNA, 20 bp, Homo sapiens
aatgttgctcagccccacag

SEQ ID NO: 1948 - DNA, 23 bp, Homo sapiens
tgtggaatttggaaacatccatt

SEQ ID NO: 1949 - DNA, 20 bp, Homo sapiens
ccatgcctgtatcagggtca

SEQ ID NO: 1950 - DNA, 21 bp, Homo sapiens
gggtgacagtggagcttcctt

SEQ ID NO: 1951 - DNA, 20 bp, Homo sapiens
cccacattcacagggctctt

SEQ ID NO: 1952 - DNA, 22 bp, Homo sapiens
tcaactgctgcttcaccagact

SEQ ID NO: 1953 - DNA, 20 bp, Homo sapiens
ttcaaagctgttggccctct

SEQ ID NO: 1954 - DNA, 21 bp, Homo sapiens
tgacgcccctattctctcctc

SEQ ID NO: 1955 - DNA, 20 bp, Homo sapiens
agggcacttccagctcttcc

SEQ ID NO: 1956 - DNA, 20 bp, Homo sapiens
ggacttcttcacggccacag

SEQ ID NO: 1957 - DNA, 20 bp, Homo sapiens
tgcgttcagcagactggttt

SEQ ID NO: 1958 - DNA, 20 bp, Homo sapiens
agaatggccgccagtgttac

SEQ ID NO: 1959 - DNA, 20 bp, Homo sapiens
ctggcattgcaaaactggaa

SEQ ID NO: 1960 - DNA, 22 bp, Homo sapiens
tcaccaccaatcacaaggaaga

SEQ ID NO: 1961 - DNA, 20 bp, Homo sapiens
gcaccaggcatgaaatctcc

SEQ ID NO: 1962 - DNA, 20 bp, Homo sapiens
gggaggccatacggtttagg

SEQ ID NO: 1963 - DNA, 20 bp, Homo sapiens
gatctcctggggttcctgct

SEQ ID NO: 1964 - DNA, 20 bp, Homo sapiens
cagagatgtggcggtctcaa

SEQ ID NO: 1965 - DNA, 20 bp, Homo sapiens
ccctgaaggtgaaccgctta

SEQ ID NO: 1966 - DNA, 22 bp, Homo sapiens
aacggaaagtccgaatcctaca

SEQ ID NO: 1967 - DNA, 24 bp, Homo sapiens
tcatgagattctgctgtacgtgtg

SEQ ID NO: 1968 - DNA, 20 bp, Homo sapiens
catctttctcggggttctcg

SEQ ID NO: 1969 - DNA, 29 bp, Homo sapiens
cagagcatgtatgagaactacattgtacc

SEQ ID NO: 1970 - DNA, 20 bp, Homo sapiens
ctctcagaagccccactgga

SEQ ID NO: 1971 - DNA, 20 bp, Homo sapiens
gcacctcagctgttcccagt

SEQ ID NO: 1972 - DNA, 20 bp, Homo sapiens
gtcgcccagtcctaccagag

SEQ ID NO: 1973 - DNA, 29 bp, Homo sapiens
taagatatctaaggcattctgcaaacatc

SEQ ID NO: 1974 - DNA, 21 bp, Homo sapiens
agacagggattccttggcaac

SEQ ID NO: 1975 - DNA, 21 bp, Homo sapiens
tccgtgttcaaggcctcataa

SEQ ID NO: 1976 - DNA, 22 bp, Homo sapiens
ctgcacatggcaggtgtatctc

SEQ ID NO: 1977 - DNA, 28 bp, Homo sapiens
tttagcttaacttgcttagggaattttg

SEQ ID NO: 1978 - DNA, 20 bp, Homo sapiens
aggccgttgagctggtacac

SEQ ID NO: 1979 - DNA, 22 bp, Homo sapiens
gcaaaatctgcaaatcccagaa

SEQ ID NO: 1980 - DNA, 21 bp, Homo sapiens
ggccgactgaagggtaaaatg

SEQ ID NO: 1981 - DNA, 20 bp, Homo sapiens
acttgggcactgcctcattc

SEQ ID NO: 1982 - DNA, 21 bp, Homo sapiens
ggcatgcacacacacaacagt

SEQ ID NO: 1983 - DNA, 22 bp, Homo sapiens
caagccccaagttgtctcattt

SEQ ID NO: 1984 - DNA, 22 bp, Homo sapiens
tctttgtctttcttggccgact

SEQ ID NO: 1985 - DNA, 20 bp, Homo sapiens
cagctcagggatgaccttgc

SEQ ID NO: 1986 - DNA, 18 bp, Homo sapiens
gtccaccggcccctacat

SEQ ID NO: 1987 - DNA, 20 bp, Homo sapiens
aaaggggcaattttggttgg

SEQ ID NO: 1988 - DNA, 19 bp, Homo sapiens
accatgcaggtggaagcag

SEQ ID NO: 1989 - DNA, 20 bp, Homo sapiens
ggtgtggaggtgggagtcag

SEQ ID NO: 1990 - DNA, 21 bp, Homo sapiens
tgtgctgtgaatggcacaact

SEQ ID NO: 1991 - DNA, 23 bp, Homo sapiens
ttgctgggtttatcattctgagg

SEQ ID NO: 1992 - DNA, 27 bp, Homo sapiens
atttatttcacgtgaggtagaggacag

SEQ ID NO: 1993 - DNA, 23 bp, Homo sapiens
caggataatcagaccaccacagg

SEQ ID NO: 1994 - DNA, 20 bp, Homo sapiens
ccccgcgaactagatttgaa

SEQ ID NO: 1995 - DNA, 20 bp, Homo sapiens
tctctgcaggaggtgaagca

SEQ ID NO: 1996 - DNA, 20 bp, Homo sapiens
gccagattggcatgaaggac

SEQ ID NO: 1997 - DNA, 20 bp, Homo sapiens
aaggacagcagtgcctccag

SEQ ID NO: 1998 - DNA, 21 bp, Homo sapiens
ttgggtagttgctccagttgc

SEQ ID NO: 1999 - DNA, 25 bp, Homo sapiens
tgtcagctgaacattgtccataaac

SEQ ID NO: 2000 - DNA, 24 bp, Homo sapiens
cagtattttggccaacttctgctt

SEQ ID NO: 2001 - DNA, 22 bp, Homo sapiens
taaaggtacgcacttgggcttc

SEQ ID NO: 2002 - DNA, 21 bp, Homo sapiens
aaaccaccacgacgatgaaac

SEQ ID NO: 2003 - DNA, 21 bp, Homo sapiens
agctcatattcctgggcatcc

SEQ ID NO: 2004 - DNA, 20 bp, Homo sapiens
gcctgagctgaagggattga

SEQ ID NO: 2005 - DNA, 27 bp, Homo sapiens
acaacattctgctcaacatcatttaca

SEQ ID NO: 2006 - DNA, 20 bp, Homo sapiens
gggcagagtcagccactgat

SEQ ID NO: 2007 - DNA, 18 bp, Homo sapiens
catgacgccccaaccatt

SEQ ID NO: 2008 - DNA, 19 bp, Homo sapiens
ctggacctgggacctgcat

SEQ ID NO: 2009 - DNA, 20 bp, Homo sapiens
gcgaggggatgggtttattg

SEQ ID NO: 2010 - DNA, 20 bp, Homo sapiens
ggagggagagttgcctggtc

SEQ ID NO: 2011 - DNA, 25 bp, Homo sapiens
agtgattgctttggtgcttaacttg

SEQ ID NO: 2012 - DNA, 21 bp, Homo sapiens
accctgatgctggtcatggta

SEQ ID NO: 2013 - DNA, 20 bp, Homo sapiens
cggggttggaggcatatttc

SEQ ID NO: 2014 - DNA, 20 bp, Homo sapiens
agaaggggaaggaggggtct

SEQ ID NO: 2015 - DNA, 21 bp, Homo sapiens
cttctcaaacacctgcccaca

SEQ ID NO: 2016 - DNA, 19 bp, Homo sapiens
caaaggcccctcagaacga

SEQ ID NO: 2017 - DNA, 20 bp, Homo sapiens
gaagctctggccctccaact

SEQ ID NO: 2018 - DNA, 22 bp, Homo sapiens
cattgagtagatgccccggata

SEQ ID NO: 2019 - DNA, 18 bp, Homo sapiens
ctggcagggcttccttca

SEQ ID NO: 2020 - DNA, 20 bp, Homo sapiens
ctgcccctgatgcaaaagtt

SEQ ID NO: 2021 - DNA, 22 bp, Homo sapiens
ttcaagggcacagctatgtttg

SEQ ID NO: 2022 - DNA, 20 bp, Homo sapiens
tgacccagctgaagacagga

SEQ ID NO: 2023 - DNA, 20 bp, Homo sapiens
tcccacaacaagccacagag

SEQ ID NO: 2024 - DNA, 19 bp, Homo sapiens
cagcacgtgcacagcagac

SEQ ID NO: 2025 - DNA, 25 bp, Homo sapiens
tgaatttctgactgcagatgttttg

SEQ ID NO: 2026 - DNA, 21 bp, Homo sapiens
agctccagcagccttcttgtc

SEQ ID NO: 2027 - DNA, 19 bp, Homo sapiens
gagtgggttggggaactgg

SEQ ID NO: 2028 - DNA, 22 bp, Homo sapiens
cttactccttggaggccatgtg

SEQ ID NO: 2029 - DNA, 21 bp, Homo sapiens
caacatggaagatgggcagaa

SEQ ID NO: 2030 - DNA, 21 bp, Homo sapiens
ggtcgtcatcgttgttgtcct

SEQ ID NO: 2031 - DNA, 20 bp, Homo sapiens
cgcttttgctgggactttca

SEQ ID NO: 2032 - DNA, 20 bp, Homo sapiens
cccttgcacaaaacccactc

SEQ ID NO: 2033 - DNA, 22 bp, Homo sapiens
tttggagaaaagtgggtccaag

SEQ ID NO: 2034 - DNA, 20 bp, Homo sapiens
catccttggtgggtcctagc

SEQ ID NO: 2035 - DNA, 21 bp, Homo sapiens
ggcagtgcctttgatcagtgt

SEQ ID NO: 2036 - DNA, 20 bp, Homo sapiens
ctgccacgcccatctttatc

SEQ ID NO: 2037 - DNA, 28 bp, Homo sapiens
acagtatctatcctaggcaaatgagagc

SEQ ID NO: 2038 - DNA, 20 bp, Homo sapiens
tcttcccctcgcacgtctta

SEQ ID NO: 2039 - DNA, 20 bp, Homo sapiens
tcctcctgtaggctggcaga

SEQ ID NO: 2040 - DNA, 21 bp, Homo sapiens
tcctctctcaacctgccactc

SEQ ID NO: 2041 - DNA, 19 bp, Homo sapiens
catgtccccttcccaagga

SEQ ID NO: 2042 - DNA, 20 bp, Homo sapiens
agctcccagctgacctctga

SEQ ID NO: 2043 - DNA, 21 bp, Homo sapiens
gaatgtgctccaaggcgatta

SEQ ID NO: 2044 - DNA, 20 bp, Homo sapiens
ccctcccttctcagccaaag

SEQ ID NO: 2045 - DNA, 21 bp, Homo sapiens
cagagggatgaagctggacaa

SEQ ID NO: 2046 - DNA, 22 bp, Homo sapiens
tttcaaaacaggcagagggaat

SEQ ID NO: 2047 - DNA, 22 bp, Homo sapiens
tcccactgaaagtcacagtcca

SEQ ID NO: 2048 - DNA, 20 bp, Homo sapiens
tgcagcaagtgtgcaacaga

SEQ ID NO: 2049 - DNA, 20 bp, Homo sapiens
tcgttttcgttcccctcttg

SEQ ID NO: 2050 - DNA, 20 bp, Homo sapiens
gagctctggctgatggaacc

SEQ ID NO: 2051 - DNA, 20 bp, Homo sapiens
ggaaggaggcaatgtgggta

SEQ ID NO: 2052 - DNA, 20 bp, Homo sapiens
gctttgcctctcggaggagt

SEQ ID NO: 2053 - DNA, 22 bp, Homo sapiens
ggaagacagaggaaagggaagc

SEQ ID NO: 2054 - DNA, 20 bp, Homo sapiens
ggcagaaattcagggaccaa

SEQ ID NO: 2055 - DNA, 29 bp, Homo sapiens
atgtagaattttcttactccatgatgagg

SEQ ID NO: 2056 - DNA, 25 bp, Homo sapiens
tgttttcattccactactccctcaa

SEQ ID NO: 2057 - DNA, 21 bp, Homo sapiens
tggctgcactaaacatccaca

SEQ ID NO: 2058 - DNA, 19 bp, Homo sapiens
gcccgtgggtgtaatccat

SEQ ID NO: 2059 - DNA, 20 bp, Homo sapiens
accaggagacagcgctacca

SEQ ID NO: 2060 - DNA, 24 bp, Homo sapiens
tcccactaacatgaaatgaatgga

SEQ ID NO: 2061 - DNA, 20 bp, Homo sapiens
agtttggggaggccatatcc

SEQ ID NO: 2062 - DNA, 20 bp, Homo sapiens
cagatgctcacctgctcgtc

SEQ ID NO: 2063 - DNA, 21 bp, Homo sapiens
tggggatccactttcttcaaa

SEQ ID NO: 2064 - DNA, 20 bp, Homo sapiens
ttctggctgaggggtcacat

SEQ ID NO: 2065 - DNA, 20 bp, Homo sapiens
gtccttggagccaagcagag

SEQ ID NO: 2066 - DNA, 20 bp, Homo sapiens
accagtggaaccagggtgag

SEQ ID NO: 2067 - DNA, 20 bp, Homo sapiens
aggagggaggggcacagtag

SEQ ID NO: 2068 - DNA, 20 bp, Homo sapiens
gtgccatagccggatgttct

SEQ ID NO: 2069 - DNA, 20 bp, Homo sapiens
gactccttggcatcggacac

SEQ ID NO: 2070 - DNA, 27 bp, Homo sapiens
tcatgctttcctcattattattgatcc

SEQ ID NO: 2071 - DNA, 21 bp, Homo sapiens
ttgctgtttgggtgcatactg

SEQ ID NO: 2072 - DNA, 28 bp, Homo sapiens
tttgaatgaatattaggaattgatgctg

SEQ ID NO: 2073 - DNA, 20 bp, Homo sapiens
acaacggtgaccatctgcaa

SEQ ID NO: 2074 - DNA, 22 bp, Homo sapiens
accagattcaaaagggaaagca

SEQ ID NO: 2075 - DNA, 20 bp, Homo sapiens
ctcatgaaacgtccccgaat

SEQ ID NO: 2076 - DNA, 20 bp, Homo sapiens
aggccagggtctctggaaga

SEQ ID NO: 2077 - DNA, 20 bp, Homo sapiens
acagcagccaaacaaaagca

SEQ ID NO: 2078 - DNA, 20 bp, Homo sapiens
ctgaaagctcaggggtggaa

SEQ ID NO: 2079 - DNA, 20 bp, Homo sapiens
cagcagggtccggtcatact

SEQ ID NO: 2080 - DNA, 32 bp, Homo sapiens
acaaaacaaattcacaaattactctcaatact

SEQ ID NO: 2081 - DNA, 26 bp, Homo sapiens
tctgtgaaaatctttctgcaaatgtc

SEQ ID NO: 2082 - DNA, 28 bp, Homo sapiens
agtaaaaccagacaaacgaataacacac

SEQ ID NO: 2083 - DNA, 18 bp, Homo sapiens
ccgagcccgataaatggt

SEQ ID NO: 2084 - DNA, 20 bp, Homo sapiens
tcccctccctgtagagacca

SEQ ID NO: 2085 - DNA, 20 bp, Homo sapiens
cccgacctggggtatctctt

SEQ ID NO: 2086 - DNA, 20 bp, Homo sapiens
cttgaagggacgtgggacat

SEQ ID NO: 2087 - DNA, 20 bp, Homo sapiens
tttggtgccatgactgccta

SEQ ID NO: 2088 - DNA, 23 bp, Homo sapiens
ttcgctctctgctgaagaagatt

SEQ ID NO: 2089 - DNA, 22 bp, Homo sapiens
aagagtgtggcctgagtcctct

SEQ ID NO: 2090 - DNA, 20 bp, Homo sapiens
ttggggcttgtggagaagag

SEQ ID NO: 2091 - DNA, 22 bp, Homo sapiens
aagaccctcattcccactttca

SEQ ID NO: 2092 - DNA, 20 bp, Homo sapiens
ccccacttcttgcattcagc

SEQ ID NO: 2093 - DNA, 20 bp, Homo sapiens
actccaaggacacggcagag

SEQ ID NO: 2094 - DNA, 20 bp, Homo sapiens
cgccgtgagaaatcagtttg

SEQ ID NO: 2095 - DNA, 28 bp, Homo sapiens
accatcacttacaaatctgtacccaatc

SEQ ID NO: 2096 - DNA, 27 bp, Homo sapiens
tgagtaagttcttgttctttccgttct

SEQ ID NO: 2097 - DNA, 20 bp, Homo sapiens
gatcccagctgccttttgaa

SEQ ID NO: 2098 - DNA, 28 bp, Homo sapiens
tgtgattatacaaaatgaagtggacaaa

SEQ ID NO: 2099 - DNA, 20 bp, Homo sapiens
ccctctccaacaccttcacg

SEQ ID NO: 2100 - DNA, 20 bp, Homo sapiens
aggcctggtccttcactggt

SEQ ID NO: 2101 - DNA, 22 bp, Homo sapiens
cagtctcacactggtccttgct

SEQ ID NO: 2102 - DNA, 20 bp, Homo sapiens
caatggcattaaggggcaaa

SEQ ID NO: 2103 - DNA, 20 bp, Homo sapiens
tccacgatcatctcgtctgg

SEQ ID NO: 2104 - DNA, 20 bp, Homo sapiens
ctgaggggtgcagagtgtga

SEQ ID NO: 2105 - DNA, 25 bp, Homo sapiens
cagtctttgtcataggcaaacttga

SEQ ID NO: 2106 - DNA, 20 bp, Homo sapiens
tccagagcaagccgaaactt

SEQ ID NO: 2107 - DNA, 24 bp, Homo sapiens
ttcacaatggctaacaagaacagg

SEQ ID NO: 2108 - DNA, 20 bp, Homo sapiens
ccaaagcaggccagcaatac

SEQ ID NO: 2109 - DNA, 19 bp, Homo sapiens
gacgaagggctaccgcact

SEQ ID NO: 2110 - DNA, 21 bp, Homo sapiens
gctatttcgaggggatgtgct

SEQ ID NO: 2111 - DNA, 27 bp, Homo sapiens
aaattctttgcttgttagtgaccttga

SEQ ID NO: 2112 - DNA, 24 bp, Homo sapiens
tgcaaccttttaagcatagccata

SEQ ID NO: 2113 - DNA, 20 bp, Homo sapiens
gaagcccctgttctgctcaa

SEQ ID NO: 2114 - DNA, 20 bp, Homo sapiens
tttgttcccttggagggttg

SEQ ID NO: 2115 - DNA, 23 bp, Homo sapiens
ctaacccataagtgcctcataca

SEQ ID NO: 2116 - DNA, 20 bp, Homo sapiens
cagggcatgtgtagcaggaa

SEQ ID NO: 2117 - DNA, 22 bp, Homo sapiens
gcctgagagtagctccctcctt

SEQ ID NO: 2118 - DNA, 21 bp, Homo sapiens
gacttgtacgggttcgggttt

SEQ ID NO: 2119 - DNA, 20 bp, Homo sapiens
ggagctgggagctcgaaagt

SEQ ID NO: 2120 - DNA, 20 bp, Homo sapiens
gcgtgcagctcatcttggta

SEQ ID NO: 2121 - DNA, 21 bp, Homo sapiens
ttttgccaaatgggttccttt

SEQ ID NO: 2122 - DNA, 19 bp, Homo sapiens
atcgaagtcgccgacaatg

SEQ ID NO: 2123 - DNA, 20 bp, Homo sapiens
gatcaccagcaagggagtgc

SEQ ID NO: 2124 - DNA, 35 bp, Homo sapiens
ttaataattcatacctagtactaagcggtaacaac

SEQ ID NO: 2125 - DNA, 24 bp, Homo sapiens
cctgctttcttctttcattgatcc

SEQ ID NO: 2126 - DNA, 22 bp, Homo sapiens
cctgaggccagtgatagggtaa

SEQ ID NO: 2127 - DNA, 20 bp, Homo sapiens
gcactgctgctcatttcctg

SEQ ID NO: 2128 - DNA, 20 bp, Homo sapiens
tccttcccctttgccaatct

SEQ ID NO: 2129 - DNA, 21 bp, Homo sapiens
accggagaaaagtgggttgag

SEQ ID NO: 2130 - DNA, 21 bp, Homo sapiens
aagctcaagaaggctgggaga

SEQ ID NO: 2131 - DNA, 22 bp, Homo sapiens
cacccactgttcttacccttgc

SEQ ID NO: 2132 - DNA, 21 bp, Homo sapiens
tcctgcctaactgaccacctg

SEQ ID NO: 2133 - DNA, 23 bp, Homo sapiens
cagactccaagtccaaagcaaat

SEQ ID NO: 2134 - DNA, 25 bp, Homo sapiens
tgatttccaaatctcagttgacctc

SEQ ID NO: 2135 - DNA, 20 bp, Homo sapiens
gcttcctggaattccctgct

SEQ ID NO: 2136 - DNA, 20 bp, Homo sapiens
tgaagggtcccacgctgtat

SEQ ID NO: 2137 - DNA, 21 bp, Homo sapiens
tgcatcagtcaaggtcatgga

SEQ ID NO: 2138 - DNA, 19 bp, Homo sapiens
cgagggctcgtcatttggt

SEQ ID NO: 2139 - DNA, 20 bp, Homo sapiens
ctgagagcgaccacctaccg

SEQ ID NO: 2140 - DNA, 20 bp, Homo sapiens
gctgtgcccaaatgagcttt

SEQ ID NO: 2141 - DNA, 31 bp, Homo sapiens
gtatctcaattcagaaagctttgactactgt

SEQ ID NO: 2142 - DNA, 21 bp, Homo sapiens
tttgatccccagtgtttgctc

SEQ ID NO: 2143 - DNA, 20 bp, Homo sapiens
attccaagtcagcgccaaag

SEQ ID NO: 2144 - DNA, 20 bp, Homo sapiens
atgccacttcattggcacct

SEQ ID NO: 2145 - DNA, 20 bp, Homo sapiens
tgctggaaggcaaaccagat

SEQ ID NO: 2146 - DNA, 29 bp, Homo sapiens
tcccagaagagatgacggaggctaccttc

SEQ ID NO: 2147 - DNA, 20 bp, Homo sapiens
cgctgtgtgttctcccctct

SEQ ID NO: 2148 - DNA, 21 bp, Homo sapiens
tggaacagtttctccccaatg

SEQ ID NO: 2149 - DNA, 24 bp, Homo sapiens
tcaattggacagaaatgacaagga

SEQ ID NO: 2150 - DNA, 21 bp, Homo sapiens
tctggctcactccaaatcagc

SEQ ID NO: 2151 - DNA, 20 bp, Homo sapiens
gcctgacttggcctgctact

SEQ ID NO: 2152 - DNA, 20 bp, Homo sapiens
tcacacagccatcacacagg

SEQ ID NO: 2153 - DNA, 24 bp, Homo sapiens
tgccaatgaaaccaggtatcccca

SEQ ID NO: 2154 - DNA, 33 bp, Homo sapiens
tgagtggctggtgtcttttggttagtgtaacca

SEQ ID NO: 2155 - DNA, 20 bp, Homo sapiens
ggccagcacaatgccccagg

SEQ ID NO: 2156 - DNA, 29 bp, Homo sapiens
tcaggcaaattcacaacccagtgagtctg

SEQ ID NO: 2157 - DNA, 25 bp, Homo sapiens
tgacagccacaatgctcaccgttca

SEQ ID NO: 2158 - DNA, 26 bp, Homo sapiens
cagctcccaaccctttgtgtctcagc

SEQ ID NO: 2159 - DNA, 30 bp, Homo sapiens
ggatgatgactgctgttacgaaacacacca

SEQ ID NO: 2160 - DNA, 27 bp, Homo sapiens
tgcagagcagtgttcttccagctgtga

SEQ ID NO: 2161 - DNA, 24 bp, Homo sapiens
ggcagaaaatcgtcttggtcgcca

SEQ ID NO: 2162 - DNA, 32 bp, Homo sapiens
ccaaaactacaagcctttgaaggaccaaagga

SEQ ID NO: 2163 - DNA, 22 bp, Homo sapiens
gggtgcagagcaaggaaggggc

SEQ ID NO: 2164 - DNA, 30 bp, Homo sapiens
tcaggaaggtaaagcaaatctctggaggca

SEQ ID NO: 2165 - DNA, 20 bp, Homo sapiens
cttccccagccagccacccg

SEQ ID NO: 2166 - DNA, 28 bp, Homo sapiens
ttgtgggggtagggtagggaagttcaca

SEQ ID NO: 2167 - DNA, 20 bp, Homo sapiens
ccacggtccacacagccccc

SEQ ID NO: 2168 - DNA, 20 bp, Homo sapiens
cttcccctcggggcaggctg

SEQ ID NO: 2169 - DNA, 28 bp, Homo sapiens
tgggtgggcttatccaccatcttcttca

SEQ ID NO: 2170 - DNA, 22 bp, Homo sapiens
cccctcggaaaacaccctcgca

SEQ ID NO: 2171 - DNA, 20 bp, Homo sapiens
gaactcggcggggaggtggg

SEQ ID NO: 2172 - DNA, 20 bp, Homo sapiens
ggtgccgatggtgtcggcct

SEQ ID NO: 2173 - DNA, 27 bp, Homo sapiens
tgccctggcccacaagtatcactaagc

SEQ ID NO: 2174 - DNA, 27 bp, Homo sapiens
tgccctggctcacaagtaccattgaga

SEQ ID NO: 2175 - DNA, 21 bp, Homo sapiens
gccatgggccttgaccttggg

SEQ ID NO: 2176 - DNA, 23 bp, Homo sapiens
cccatgatggcagaggcagagga

SEQ ID NO: 2177 - DNA, 20 bp, Homo sapiens
gccggggctcaggtccaggt

SEQ ID NO: 2178 - DNA, 20 bp, Homo sapiens
gcagggtggagcactggggc

SEQ ID NO: 2179 - DNA, 26 bp, Homo sapiens
tggtgactggaccttccagatcctgg

SEQ ID NO: 2180 - DNA, 23 bp, Homo sapiens
gatgctgagtggagtcgggggct

SEQ ID NO: 2181 - DNA, 20 bp, Homo sapiens
ggccaggtgggccaccatga

SEQ ID NO: 2182 - DNA, 35 bp, Homo sapiens
cagtcatatcttcaaatagaggccgatttccttgg

SEQ ID NO: 2183 - DNA, 28 bp, Homo sapiens
ttccatcagaatgtcttggtcttcccca

SEQ ID NO: 2184 - DNA, 20 bp, Homo sapiens
ccgtcccctctcccggagga

SEQ ID NO: 2185 - DNA, 20 bp, Homo sapiens
acttcgaaaccggcccgccc

SEQ ID NO: 2186 - DNA, 20 bp, Homo sapiens
caaccccagccctgccctcc

SEQ ID NO: 2187 - DNA, 20 bp, Homo sapiens
cagtggggcagtggggtccg

SEQ ID NO: 2188 - DNA, 20 bp, Homo sapiens
ggcgcccaggtgaagagcca

SEQ ID NO: 2189 - DNA, 26 bp, Homo sapiens
tgcaatcaaaaaccacctgcatccaa

SEQ ID NO: 2190 - DNA, 27 bp, Homo sapiens
tgcttttaagttttggccaactgccga

SEQ ID NO: 2191 - DNA, 21 bp, Homo sapiens
tcccagtcagggagcccacgg

SEQ ID NO: 2192 - DNA, 20 bp, Homo sapiens
aggcccaggatggcggcaac

SEQ ID NO: 2193 - DNA, 34 bp, Homo sapiens
tgataactgctcttgaaggactcacaaagatggc

SEQ ID NO: 2194 - DNA, 20 bp, Homo sapiens
ccctctggctgttcccggca

SEQ ID NO: 2195 - DNA, 23 bp, Homo sapiens
ggtgaaggcttggaggagtggcg

SEQ ID NO: 2196 - DNA, 27 bp, Homo sapiens
cgtggagtttctccagtcaaggtccca

SEQ ID NO: 2197 - DNA, 20 bp, Homo sapiens
tcccaccatggctgtggccc

SEQ ID NO: 2198 - DNA, 22 bp, Homo sapiens
tccctcccacatccccagtccc

SEQ ID NO: 2199 - DNA, 23 bp, Homo sapiens
ggacccaaaccagacacctggcc

SEQ ID NO: 2200 - DNA, 30 bp, Homo sapiens
cctttgaaaacaagagtaaacgcagacggc

SEQ ID NO: 2201 - DNA, 30 bp, Homo sapiens
ctgattgcccagaactggtatttcctttgc

SEQ ID NO: 2202 - DNA, 24 bp, Homo sapiens
ggcccattcttgccactctccctg

SEQ ID NO: 2203 - DNA, 19 bp, Homo sapiens
agggggacgtggcgggacc

SEQ ID NO: 2204 - DNA, 20 bp, Homo sapiens
gggggagaaccccagggcct

SEQ ID NO: 2205 - DNA, 34 bp, Homo sapiens
gggggtgataaggaaagaaatgaaaattcactgc

SEQ ID NO: 2206 - DNA, 20 bp, Homo sapiens
tcatggggcctcggcagtca

SEQ ID NO: 2207 - DNA, 31 bp, Homo sapiens
tgtgacatctccatccagtgatatttgtgca

SEQ ID NO: 2208 - DNA, 20 bp, Homo sapiens
tgggttaggggatgcggggg

SEQ ID NO: 2209 - DNA, 30 bp, Homo sapiens
tgaatgtgtcaggtgaccctgatgaaaaca

SEQ ID NO: 2210 - DNA, 29 bp, Homo sapiens
gcctcatcttcaacttttgtgctcccctt

SEQ ID NO: 2211 - DNA, 26 bp, Homo sapiens
tggttggcttcttggccacctttttg

SEQ ID NO: 2212 - DNA, 20 bp, Homo sapiens
aatgcagctggggccagggg

SEQ ID NO: 2213 - DNA, 23 bp, Homo sapiens
cggactcgtctgggttcttggcc

SEQ ID NO: 2214 - DNA, 21 bp, Homo sapiens
tggtcatggcggtggtggtca

SEQ ID NO: 2215 - DNA, 35 bp, Homo sapiens
tggttattcgctggttcgttctaagatgagtatcg

SEQ ID NO: 2216 - DNA, 28 bp, Homo sapiens
gttttgagggattcttcggccaactctg

SEQ ID NO: 2217 - DNA, 26 bp, Homo sapiens
gccatccacatctcccgcttatcctc

SEQ ID NO: 2218 - DNA, 20 bp, Homo sapiens
cccggcccagggtcctgatc

SEQ ID NO: 2219 - DNA, 21 bp, Homo sapiens
ggtgcttctcccccggcttgg

SEQ ID NO: 2220 - DNA, 23 bp, Homo sapiens
cggactcgtctgggttcttggcc

SEQ ID NO: 2221 - DNA, 25 bp, Homo sapiens
tgctgcggcatagaatcaaggagca

SEQ ID NO: 2222 - DNA, 30 bp, Homo sapiens
tggtcagggagatatctctccacacttgca

SEQ ID NO: 2223 - DNA, 29 bp, Homo sapiens
cccaatctaaaggagcttctgccaaagga

SEQ ID NO: 2224 - DNA, 21 bp, Homo sapiens
ccatcccctgcaggcctggtc

SEQ ID NO: 2225 - DNA, 33 bp, Homo sapiens
gaacagaacattcagtggccaattttcataccc

SEQ ID NO: 2226 - DNA, 20 bp, Homo sapiens
cgtccggaaggcattggcca

SEQ ID NO: 2227 - DNA, 22 bp, Homo sapiens
caacctccaggggcagggagga

SEQ ID NO: 2228 - DNA, 26 bp, Homo sapiens
aacccagctacaacggatgcaaaggg

SEQ ID NO: 2229 - DNA, 21 bp, Homo sapiens
tggctacgctcccagcagccc

SEQ ID NO: 2230 - DNA, 28 bp, Homo sapiens
gaaaacttcagggtcagctagctggggc

SEQ ID NO: 2231 - DNA, 32 bp, Homo sapiens
ccttgctccatcttgacaaatcacttttctgc

SEQ ID NO: 2232 - DNA, 27 bp, Homo sapiens
gcattgcgaagctcggagaatagcagc

SEQ ID NO: 2233 - DNA, 20 bp, Homo sapiens
gttctggagagccccgcggc

SEQ ID NO: 2234 - DNA, 23 bp, Homo sapiens
ccagggcctttgcaaacaagcca

SEQ ID NO: 2235 - DNA, 28 bp, Homo sapiens
tttcaagcaggggtttccttggcttttt

SEQ ID NO: 2236 - DNA, 20 bp, Homo sapiens
ggcctccccatcccagcctg

SEQ ID NO: 2237 - DNA, 23 bp, Homo sapiens
tgacggccaggatgatgagcagg

SEQ ID NO: 2238 - DNA, 24 bp, Homo sapiens
tccagcctgggaagtacacaggcg

SEQ ID NO: 2239 - DNA, 33 bp, Homo sapiens
tcacaaagtctcagtccagtctcttgccttagc

SEQ ID NO: 2240 - DNA, 29 bp, Homo sapiens
tgtgtcatgtaatgcaaccaaccacagca

SEQ ID NO: 2241 - DNA, 29 bp, Homo sapiens
gcagttctcacgttgaggtctgtggaaga

SEQ ID NO: 2242 - DNA, 21 bp, Homo sapiens
tggcgccaacaccggtacgtt

SEQ ID NO: 2243 - DNA, 24 bp, Homo sapiens
tggcagccgtgtcattagttgggg

SEQ ID NO: 2244 - DNA, 20 bp, Homo sapiens
tctggagggccaggtggggg

SEQ ID NO: 2245 - DNA, 27 bp, Homo sapiens
gctcaactctggagcctctggtaggca

SEQ ID NO: 2246 - DNA, 22 bp, Homo sapiens
ggtgccttaagtgagggccgcc

SEQ ID NO: 2247 - DNA, 33 bp, Homo sapiens
ggaccttttgtacttggtacaagttctgcaccg

SEQ ID NO: 2248 - DNA, 32 bp, Homo sapiens
tgcttttgtttatggacaatgttcagctgaca

SEQ ID NO: 2249 - DNA, 28 bp, Homo sapiens
cctgtatgctagcaggaatgttgctggc

SEQ ID NO: 2250 - DNA, 19 bp, Homo sapiens
ctacgcatccgtggccgcg

SEQ ID NO: 2251 - DNA, 22 bp, Homo sapiens
tgggccactttgttccagccga

SEQ ID NO: 2252 - DNA, 19 bp, Homo sapiens
cgccgcctccttgctggct

SEQ ID NO: 2253 - DNA, 29 bp, Homo sapiens
gcacaacttggtaaggcaccaggttacga

SEQ ID NO: 2254 - DNA, 20 bp, Homo sapiens
accccctcagcctcggccag

SEQ ID NO: 2255 - DNA, 20 bp, Homo sapiens
ctgggccagcttgcacgcct

SEQ ID NO: 2256 - DNA, 24 bp, Homo sapiens
tctgcaggcaaccagccagtcatg

SEQ ID NO: 2257 - DNA, 20 bp, Homo sapiens
agcagcgtggcggcgaaaga

SEQ ID NO: 2258 - DNA, 24 bp, Homo sapiens
tggggcattttcctttgtttggca

SEQ ID NO: 2259 - DNA, 34 bp, Homo sapiens
ccacttcctaaagcagctacatgaaacagcttca

SEQ ID NO: 2260 - DNA, 21 bp, Homo sapiens
tccgtgtccaccatcgggctg

SEQ ID NO: 2261 - DNA, 20 bp, Homo sapiens
tgcggcgagctatgggggtg

SEQ ID NO: 2262 - DNA, 34 bp, Homo sapiens
gcagggtttgaagcaatacccaggtataaacact

SEQ ID NO: 2263 - DNA, 31 bp, Homo sapiens
gagatacaaagtaccagaagcgggacttggc

SEQ ID NO: 2264 - DNA, 20 bp, Homo sapiens
acagctgaaacccgcggggc

SEQ ID NO: 2265 - DNA, 26 bp, Homo sapiens
tcatggctgacttcccaaagacagcc

SEQ ID NO: 2266 - DNA, 30 bp, Homo sapiens
tccaacttaatgaaaccgatatccttcgcg

SEQ ID NO: 2267 - DNA, 24 bp, Homo sapiens
tgcactggacactggccctgactg

SEQ ID NO: 2268 - DNA, 22 bp, Homo sapiens
cccaaacaggtcatggtgcgca

SEQ ID NO: 2269 - DNA, 24 bp, Homo sapiens
tggccctgaaactcctcactccca

SEQ ID NO: 2270 - DNA, 25 bp, Homo sapiens
gagaccaatgtgcctgaaggtgcca

SEQ ID NO: 2271 - DNA, 20 bp, Homo sapiens
gggtgagggcctgatggggg

SEQ ID NO: 2272 - DNA, 20 bp, Homo sapiens
cagccactggctccctgcgg

SEQ ID NO: 2273 - DNA, 34 bp, Homo sapiens
aagtccattcctgattcagaacaccctgtctaga

SEQ ID NO: 2274 - DNA, 23 bp, Homo sapiens
tgctttgatgacacccaccgcaa

SEQ ID NO: 2275 - DNA, 20 bp, Homo sapiens
cccgctctgctggcggtcct

SEQ ID NO: 2276 - DNA, 24 bp, Homo sapiens
tccaccaccctgttgctgtagcca

SEQ ID NO: 2277 - DNA, 21 bp, Homo sapiens
cccccaggggagaagctggga

SEQ ID NO: 2278 - DNA, 21 bp, Homo sapiens
ggggtctccaccctggagcca

SEQ ID NO: 2279 - DNA, 24 bp, Homo sapiens
tggcatgggatgcagatgatttgg

SEQ ID NO: 2280 - DNA, 20 bp, Homo sapiens
gagggtggctgggggccaac

SEQ ID NO: 2281 - DNA, 25 bp, Homo sapiens
tgggacgcttttgatggctaagcca

SEQ ID NO: 2282 - DNA, 20 bp, Homo sapiens
tgccccgtctggggtctgga

SEQ ID NO: 2283 - DNA, 24 bp, Homo sapiens
acggcactgagctgatgggactcc

SEQ ID NO: 2284 - DNA, 31 bp, Homo sapiens
tcctggaagttaactgcaccatcagtgttga

SEQ ID NO: 2285 - DNA, 30 bp, Homo sapiens
tcaatttcatgatttcatctcgctcaaggc

SEQ ID NO: 2286 - DNA, 23 bp, Homo sapiens
tggcggtcacgaggaccatcttc

SEQ ID NO: 2287 - DNA, 26 bp, Homo sapiens
ggacagtggagcagccaacacacaaa

SEQ ID NO: 2288 - DNA, 30 bp, Homo sapiens
caagtaagacccaaggtagatcccaagggc

SEQ ID NO: 2289 - DNA, 33 bp, Homo sapiens
aactcaagtggatgggaagtaaagccctatgtg

SEQ ID NO: 2290 - DNA, 21 bp, Homo sapiens
cccacctggggaactgctggc

SEQ ID NO: 2291 - DNA, 22 bp, Homo sapiens
cgccagggttttcccagtcacg

SEQ ID NO: 2292 - DNA, 28 bp, Homo sapiens
ccagccctcccactttttcatcactgtt

SEQ ID NO: 2293 - DNA, 20 bp, Homo sapiens
tggaggcagagtgacggact

SEQ ID NO: 2294 - DNA, 32 bp, Homo sapiens
aggagcaaaaagccaaaatttggaaaagcttt

SEQ ID NO: 2295 - DNA, 30 bp, Homo sapiens
tcagggccaattggaaagtcattatgaaca

SEQ ID NO: 2296 - DNA, 20 bp, Homo sapiens
cagcctgtgctggcgagggc

SEQ ID NO: 2297 - DNA, 30 bp, Homo sapiens
tgcgtttatccgaaaatttattctcgccct

SEQ ID NO: 2298 - DNA, 20 bp, Homo sapiens
ccaatgcttggctgggggca

SEQ ID NO: 2299 - DNA, 20 bp, Homo sapiens
aggcctcagccccagggtcg

SEQ ID NO: 2300 - DNA, 22 bp, Homo sapiens
ggggtgagaggaaggcctgcga

SEQ ID NO: 2301 - DNA, 23 bp, Homo sapiens
gctcaagttcccagcacctgggg

SEQ ID NO: 2302 - DNA, 29 bp, Homo sapiens
tgacgcattctaatcatgtggcgatcttg

SEQ ID NO: 2303 - DNA, 33 bp, Homo sapiens; identical to SEQ ID NO: 1558

SEQ ID NO: 2304 - DNA, 36 bp, Homo sapiens
agctgcaactttacagggacttgaaaagaaagaaaa

SEQ ID NO: 2305 - DNA, 32 bp, Homo sapiens
gggaaacttcttgttgcagatactgagctgga

SEQ ID NO: 2306 - DNA, 26 bp, Homo sapiens
ttccagaaaccagcacctccctgttg

SEQ ID NO: 2307 - DNA, 27 bp, Homo sapiens
cagagagcctaggcctggcagtcttca

SEQ ID NO: 2308 - DNA, 30 bp, Homo sapiens
tggccatcctgatttcttgatcttttcaca

SEQ ID NO: 2309 - DNA, 25 bp, Homo sapiens
cgggccagccagttaaaatcgtcaa

SEQ ID NO: 2310 - DNA, 20 bp, Homo sapiens
ctccggcttctcctccgcgg

SEQ ID NO: 2311 - DNA, 26 bp, Homo sapiens
tgaacaacctgactgacacccccagg

SEQ ID NO: 2312 - DNA, 36 bp, Homo sapiens
tgcgaaacttgtatctgttttaaagaaggcacttga

SEQ ID NO: 2313 - DNA, 23 bp, Homo sapiens
tgagcaccgacagctccagctga

SEQ ID NO: 2314 - DNA, 21 bp, Homo sapiens
ggggtctgggaatggcaggca

SEQ ID NO: 2315 - DNA, 20 bp, Homo sapiens
gcgcgcaggacgacggaaac

SEQ ID NO: 2316 - DNA, 19 bp, Homo sapiens
tcgtgcgtgcctacccccg

SEQ ID NO: 2317 - DNA, 24 bp, Homo sapiens
ggggaaaagccaccctgactctgc

SEQ ID NO: 2318 - DNA, 27 bp, Homo sapiens
tgcaaaaaccagaggaagggtgtgctc

SEQ ID NO: 2319 - DNA, 21 bp, Homo sapiens
tggcaccatgatcgtggcacg

SEQ ID NO: 2320 - DNA, 28 bp, Homo sapiens
gccgtgagtttttgctcttactcccagg

SEQ ID NO: 2321 - DNA, 24 bp, Homo sapiens
gcccaatccttgcaaggtaacccg

SEQ ID NO: 2322 - DNA, 28 bp, Homo sapiens
tgtgtatttgccttcagccacatccaga

SEQ ID NO: 2323 - DNA, 34 bp, Homo sapiens
catgcttaatttgttgttaacgtagggcagctca

SEQ ID NO: 2324 - DNA, 27 bp, Homo sapiens
ccaactctcactgggaccagagagcca

SEQ ID NO: 2325 - DNA, 25 bp, Homo sapiens
ccagatggagaaggtagcctgggcc

SEQ ID NO: 2326 - DNA, 32 bp, Homo sapiens
tgaggcaaatacccacaaaaacaaacacaaaa

SEQ ID NO: 2327 - DNA, 29 bp, Homo sapiens
tttgatctccttcttggaagcctcatcca

SEQ ID NO: 2328 - DNA, 24 bp, Homo sapiens
cctgcagccagcactggtacagca

SEQ ID NO: 2329 - DNA, 35 bp, Homo sapiens
tttgcttgcttgtactcacgtttttgtaggacatt

SEQ ID NO: 2330 - DNA, 34 bp, Homo sapiens; identical to SEQ ID NO: 1585

SEQ ID NO: 2331 - DNA, 27 bp, Homo sapiens
aacgtaatcatacctctagtcatagca

SEQ ID NO: 2332 - DNA, 26 bp, Homo sapiens
ggcatctgctgcaggaaccttctgtg

SEQ ID NO: 2333 - DNA, 25 bp, Homo sapiens
gcaacccaggggaagcacagaagtg

SEQ ID NO: 2334 - DNA, 31 bp, Homo sapiens
tcatgtctgtgaagggaactggaacaactga

SEQ ID NO: 2335 - DNA, 20 bp, Homo sapiens
cgcggtgtgagggaaggggg

SEQ ID NO: 2336 - DNA, 20 bp, Homo sapiens
tgggcacatcgtgaggggcc

SEQ ID NO: 2337 - DNA, 33 bp, Homo sapiens
acaccatagtcctttgagatctgatgggtcaaa

SEQ ID NO: 2338 - DNA, 25 bp, Homo sapiens
tggcgagctcaggattcttcatcca

SEQ ID NO: 2339 - DNA, 25 bp, Homo sapiens
tgggcttgcgtttttctccaactcc

SEQ ID NO: 2340 - DNA, 32 bp, Homo sapiens
tccgttcctcaagattctattctcacccttcc

SEQ ID NO: 2341 - DNA, 29 bp, Homo sapiens
ttccagagtccaccaagaggtcctgaatc

SEQ ID NO: 2342 - DNA, 20 bp, Homo sapiens
gcgagcacggctgtggctca

SEQ ID NO: 2343 - DNA, 27 bp, Homo sapiens
ccccctctcctcaacatcttgtccagc

SEQ ID NO: 2344 - DNA, 21 bp, Homo sapiens
tgccgggccttctcctcaagg

SEQ ID NO: 2345 - DNA, 23 bp, Homo sapiens
caggtggcctggaggggagaaca

SEQ ID NO: 2346 - DNA, 30 bp, Homo sapiens
cggtcttgcacaaatgacgtacatttcaca

SEQ ID NO: 2347 - DNA, 20 bp, Homo sapiens
agccctgccctgcccctcct

SEQ ID NO: 2348 - DNA, 23 bp, Homo sapiens
ttcccaggctgcctctcctcacc

SEQ ID NO: 2349 - DNA, 31 bp, Homo sapiens
tccatcactctgagtatggtgtttgctgtcc

SEQ ID NO: 2350 - DNA, 33 bp, Homo sapiens
tccacactctcttctttgtcttgggtttcttcc

SEQ ID NO: 2351 - DNA, 24 bp, Homo sapiens
ccaccaggcccagctagcatctgg

SEQ ID NO: 2352 - DNA, 21 bp, Homo sapiens
cagggactggcctgtccccga

SEQ ID NO: 2353 - DNA, 26 bp, Homo sapiens
ctgtaagcccccttttggatgccaaa

SEQ ID NO: 2354 - DNA, 33 bp, Homo sapiens
catcctaaggcaatctgtattgaaccaggttca

SEQ ID NO: 2355 - DNA, 35 bp, Homo sapiens
tgagcagaatcccatcgtaacagttctttgttaca

SEQ ID NO: 2356 - DNA, 31 bp, Homo sapiens
ccaagtcccaagggtcagtatattggaggaa

SEQ ID NO: 2357 - DNA, 20 bp, Homo sapiens
cgcaacaacaagcgcacgca

SEQ ID NO: 2358 - DNA, 31 bp, Homo sapiens
ccctgcaagtacccagggaaggatatagtca

SEQ ID NO: 2359 - DNA, 35 bp, Homo sapiens
tttgtacgatagttgggcatctgtatttccacttg

SEQ ID NO: 2360 - DNA, 32 bp, Homo sapiens; identical to SEQ ID NO: 1616

SEQ ID NO: 2361 - DNA, 20 bp, Homo sapiens
tgggggaagggggccttggt

SEQ ID NO: 2362 - DNA, 20 bp, Homo sapiens
aacgaggcctgggctgggga

SEQ ID NO: 2363 - DNA, 32 bp, Homo sapiens; identical to SEQ ID NO: 1619

SEQ ID NO: 2364 - DNA, 21 bp, Homo sapiens
tcctggagctgtggggtggca

SEQ ID NO: 2365 - DNA, 23 bp, Homo sapiens
agcgaccacagctccgatgacca

SEQ ID NO: 2366 - DNA, 20 bp, Homo sapiens
ccgagggcgttccacccgtt

SEQ ID NO: 2367 - DNA, 24 bp, Homo sapiens
tcccccagctccctcctcactttg

SEQ ID NO: 2368 - DNA, 20 bp, Homo sapiens
acccggctgcgcaggtctga

SEQ ID NO: 2369 - DNA, 21 bp, Homo sapiens
tgagccactggcccacaaggg

SEQ ID NO: 2370 - DNA, 20 bp, Homo sapiens
tccgtgacctcgggctcccc

SEQ ID NO: 2371 - DNA, 20 bp, Homo sapiens
ccccgcgttgaaggcgttga

SEQ ID NO: 2372 - DNA, 24 bp, Homo sapiens
tgggcatgggttatcctctgctgg

SEQ ID NO: 2373 - DNA, 30 bp, Homo sapiens
tgtcgtggagtaaagagggaaacatgacca

SEQ ID NO: 2374 - DNA, 21 bp, Homo sapiens
cgggagcaggacagggagcca

SEQ ID NO: 2375 - DNA, 30 bp, Homo sapiens
tggctcagtagcaacttggggacttgtttt

SEQ ID NO: 2376 - DNA, 32 bp, Homo sapiens
tgtttttggaaatcactaatagggccagcctc

SEQ ID NO: 2377 - DNA, 26 bp, Homo sapiens
tgggagtcttgtgtctgtgccaacca

SEQ ID NO: 2378 - DNA, 21 bp, Homo sapiens
agggggaggtggcagtggctg

SEQ ID NO: 2379 - DNA, 20 bp, Homo sapiens
acgcacagggatggacgcgg

SEQ ID NO: 2380 - DNA, 29 bp, Homo sapiens
cctctgtgacatggtggtaacagcacaga

SEQ ID NO: 2381 - DNA, 27 bp, Homo sapiens
cccatggcatgaacaaataggatgcct

SEQ ID NO: 2382 - DNA, 34 bp, Homo sapiens
tcccaactgcaaaccctcatttagtctttagtga

SEQ ID NO: 2383 - DNA, 22 bp, Homo sapiens
tggagggacagaggtgggtggg

SEQ ID NO: 2384 - DNA, 33 bp, Homo sapiens
cgccagtgagttaagttgtacagaacatcgtca

SEQ ID NO: 2385 - DNA, 25 bp, Homo sapiens
gggaagacagacagcagcagaccca

SEQ ID NO: 2386 - DNA, 31 bp, Homo sapiens
caccctttggacattttgcaactcttcaatg

SEQ ID NO: 2387 - DNA, 21 bp, Homo sapiens
tgggacccaggacgacgtcca

SEQ ID NO: 2388 - DNA, 24 bp, Homo sapiens
tgccacttctggtctcgtcggtga

SEQ ID NO: 2389 - DNA, 28 bp, Homo sapiens
ctccccagcccacaatttcaaataatgc

SEQ ID NO: 2390 - DNA, 34 bp, Homo sapiens
accaacttactcttaaaaaggatggctgccaaga

SEQ ID NO: 2391 - DNA, 21 bp, Homo sapiens
tgtcagctccacgggggtccc

SEQ ID NO: 2392 - DNA, 26 bp, Homo sapiens
gagtccagaaagaaatgcctggggca

SEQ ID NO: 2393 - DNA, 25 bp, Homo sapiens
cccaaagaagggtcagccaaagcca

SEQ ID NO: 2394 - DNA, 21 bp, Homo sapiens
ggcctggtgtctgctctgcgg

SEQ ID NO: 2395 - DNA, 27 bp, Homo sapiens
tcagccaagctagcctccttagccagc

SEQ ID NO: 2396 - DNA, 34 bp, Homo sapiens
tcagtatgtaatgtcctattttcccactgcacca

SEQ ID NO: 2397 - DNA, 30 bp, Homo sapiens
ttcctgattttgcatgttctcattcccaaa

SEQ ID NO: 2398 - DNA, 29 bp, Homo sapiens
tccagaaaattggaagcagtctggaatgg

SEQ ID NO: 2399 - DNA, 25 bp, Homo sapiens
cccagttcacagtcccattctggca

SEQ ID NO: 2400 - protein, 375 aa, Homo sapiens
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 2401 - protein, 651 aa, Homo sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSPFT

SEQ ID NO: 2402 - protein, 119 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 2403 - protein, 228 aa, Homo sapiens
MSVSEIFVELQGFLAAEQDIREEIRKVVQSLEQTAREILTLLQGVHQGAGFQDIPKRCLKAREHFGTVKTHLTSLKTKFPAEQYYRFHEHWRFVLQRLVFLAAFVVYLETETLVTREAVTEILGIEPDREKGFHLDVEDYLSGVLILASELSRLSVNSVTAGDYSRPLHISTFINELDSGFRLLNLKNDSLRKRYDGLKYDVKKVEEVVYDLSIRGFNKETAAACVEK

SEQ ID NO: 2404 - protein, 378 aa, Homo sapiens
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 2405 - protein, 398 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSWGIVLAPLSLAFLVLGGIWMHRRCKHRTGKADGLTVLWPHHQDFQSYPK

SEQ ID NO: 2406 - protein, 132 aa, Homo sapiens
MEFDLNGNGDIGEKRVICGGRVVCRPKKTEVSPTCSIPHDLGGGPPTTVGGRRMGMRKWERRERVSPPSPHPHPLPPDIMSLKRMLEKLGVPKTHLELKKLIGEVSSGSGETFSYPDFLRMMLGKRSAILKM

SEQ ID NO: 2407 - protein, 587 aa, Homo sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFFEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 2408 - protein, 122 aa, Homo sapiens
MSATWCSPEGQGMGQGPGREVGGNSAASGPASPIRDPCLSEAGLKGPPSAHPRRLCLLHRLVCFSGGLTSIQLSPRTCCSHQWAQLFSPACFPQWRAPGCSLDDSRSLTRIRPVHLPGPSLD

SEQ ID NO: 2409 - protein, 288 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 2410 - protein, 588 aa, Homo sapiens
MHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTVKGGISETRIEKRIVITGDADIDHDQVLVQAIKEAKEQHPDMSVTKVVVHQETEIADE

SEQ ID NO: 2411 - protein, 982 aa, Homo sapiens
MANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKTIVPWKVFRQCLHEVHQISSGLEAMALKSTIDLTCNDYISVFEFDIFTRLFQPWGSILRNWNFLAVTHPGYMAFLTYDEVKARLQKYSTKPGSYIFRLSCTRLGQWAIGYVTGDGNILQTIPHNKPLFQALIDGSREGFYLYPDGRSYNPDLTGLCEPTPHDHIKVTQEQYELYCEMGSTFQLCKICAENDKDVKIEPCGHLMCTSCLTAWQESDGQGCPFCRCEIKGTEPIIVDPFDPRDEGSRCCSIIDPFGMPMLDLDDDDDREESLMMNRLANVRKCTDRQNSPVTSPGSSPLAQRRKPQPDPLQIPHLSLPPVPPRLDLIQKGIVRSPCGSPTGSPKSSPCMVRKQDKPLPAPPPPLRDPPPPPPERPPPIPPDNRLSRHIHHVESVPSKDPPMPLEAWCPRDVFGTNQLVGCRLLGEGSPKPGITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGDVFDSASDPVPLPPARPPTRDNPKHGSSLNRTPSDYDLLIPPLGEDAFDALPPSLPPPPPPARHSLIEHSKPPGSSSRPSSGQDLFLLPSDPFVDLASGQVPLPPARRLPGENVKTNRTSQDYDQLPSCSDGSQAPARPPKPRPRRTAPEIHHRKPHGPEAALENVDAKIAKLMGEGYAFEEVKRALEIAQNNVEVARSILREFAFPPPVSPRLNL

SEQ ID NO: 2412 - protein, 352 aa, Homo sapiens [sequence omitted]

SEQ ID NO: 2413 - protein, 750 aa, Homo sapiens
MGKSESQMDITDINTPKPKKKQRWTRLEISLSVLVLLLTIIAVRMIALYATYDDGICKSSDCIKSAARLIQNMDATTEPCRDFFKYACGGWLKRNVIPETSSRYGNFDILRDELEVVLKDVLQEPKTEDIVAVQKAKALYRSCINESAIDSRGGEPLLKLLPDIYGWPVATENWEQKYGASWTAEKAIAQLNSKYGKKVLINLFVGTDDKNSVNHVIHIDQPRLGLPSRDYYECTGIYKEACTAYVDFMISVARLIRQEERLPIDENQLALEMNKVMELEKEIANATAKPEDRNDPMLLYNKMRLAQIQNNFSLEINGKPFSWLNFTNEIMSTVNISITNEEDVVVYAPEYLTKLKPILTKYSARDLQNLMSWRFIMDLVSSLSRTYKESRNAFRKALYGTTSETATWRRCANYVNGNMENAVGRLYVEAAFAGESKHVVEDLIAQIREVFIQTLDDLTWMDAETKKRAEEKALAIKERIGYPDDIVSNDNKLNNEYLELNYKEDEYFENIIQNLKFSQSKQLKKLREKVDKDEWISGAAVVNAFYSSGRNQIVFPAGILQPPFFSAQQSNSLNYGGIGMVIGHEITHGFDDNGRNFNKDGDLVDWWTQQSASNFKEQSQCMVYQYGNFSWDLAGGQHLNGINTLGENIADNGGLGQAYRAYQNYIKKNGEEKLLPGLDLNHKQLFFLNFAQVWCGTYRPEYAVNSIKTDVHSPGNFRIIGTLQNSAEFSEAFHCRKNSYMNPEKKCRVW

SEQ ID NO: 2414 - protein, 233 aa, Homo sapiens
MDNQGVIYSDLNLPPNPKRQQRKPKGNKSSILATEQEITYAELNLQKASQDFQGNDKTYHCKDLPSAPEKLIVGILGIICLILMASVVTIVVIPSTLIQRHNNSSLNTRTQKARHCGHCPEEWITYSNSCYYIGKERRTWEESLLACTSKNSSLLSIDNEEEMKFLSIISPSSWIGVFRNSSHHPWVTMNGLAFKHEIKDSDNAELNCAVLQVNRLKSAQCGSSIIYHCKHKL

SEQ ID NO: 2415 - protein, 290 aa, Homo sapiens
MGGGAGERLFTSSCLVGLVPLGLRISLVTCPLQCGIMWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQVSFCLVMVLLFAVDTGLYFSVKTNIRSSTRDWKDHKFKWRKDPQDK

SEQ ID NO: 2416 - protein, 233 aa, Homo sapiens
MWQLLLPTALLLLVSAGMRTEDLPKAVVFLEPQWYSVLEKDSVTLKCQGAYSPEDNSTQWFHNESLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 2417 - protein, 525 aa, Homo sapiens
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLTLGVLSLLLLVTGAFGFHLWRRQWRPRRFSALEQGIHPPQAQSKIEELEQEPEPEPEPEPEPEPEPEPEQL

SEQ ID NO: 2418 - protein, 738 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKANKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVGNHAMKPINDNKEPLNSDVQYTEVQVSSAESHKDLGKKDTETVYSEVRKAVPDAVESRYSRTEGSLDGT

SEQ ID NO: 2419 - protein, 328 aa, Homo sapiens
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLELEP

SEQ ID NO: 2420 - protein, 374 aa, Homo sapiens
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGHEKKVISSLQEDRHLEEELKCQEQKEEQLQEGVHRKEPQGAT

SEQ ID NO: 2421 - protein, 760 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 2422 - protein, 247 aa, Homo sapiens
MLLLPLPLLLFLLCSRAEAGEIIGGTECKPHSRPYMAYLEIVTSNGPSKFCGGFLIRRNFVLTAAHCAGRSITVTLGAHNITEEEDTWQKLEVIKQFRHPKYNTSTLHHDIMLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 2423 - protein, 976 aa, Homo sapiens [sequence omitted]

SEQ ID NO: 2424 - protein, 635 aa, Homo sapiens
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLCSSQAQMDYRRLQPSCLGTMPLSVCPPMAESGSCCTTHIANHSYLPLSYWQQP

SEQ ID NO: 2425 - protein, 1006 aa, Homo sapiens
MVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKVDTIAADESFPSSSSSSSSSSSAAWAVGPHGAGQRAGLQLNVKERSFGPLTQRGFYVAFQDTGACLALVAVRLFSYTCPAVLRSFASFPETQASGAGGASLVAAVGTCVAHAEPEEDGVGGQAGGSPPRLHCNGEGKWMVAVGGCRCQPGYQPARGDKACQACPRGLYKSSAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 2426 - protein, 508 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 2427 - protein, 441 aa, Homo sapiens
MSPISGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKVSSSEVAVTGMASSAIAAQSGQAWVWAHRHIGEERDVGCWWWLLASEVDAHLLPVPGLPQNAIRHNLSLHKCFVRVESEKGAVWTVDELEFRKKRSQRPSRCSNPTPGP

SEQ ID NO: 2428 - protein, 413 aa, Homo sapiens
MEFPGLGSLGTSEPLPQFVDPALVSSTPESGVFFPSGPEGLDAAASSTAPSTATAAAAALAYYRDAEAYRHSPVFQVYPLLNCMEGIPGGSPYAGWAYGKTGLYPASTVCPTREDSPPQAVEDLDGKGSTSFLETLKTERLSPDLLTLGPALPSSLPVPNSAYGGPDFSSTFFSPTGSPLNSAAYSSPKLRGTLPLPPCEARECVNCGATATPLWRRDRTGHYLCNACGLYHKMNGQNRPLIRPKKRLIVSKRAGTQCTNCQTTTTTLWRRNASGDPVCNACGLYYKLHQVNRPLTMRKDGIQTRNRKASGKGKKKRGSSLGGTGAAEGPAGGFMVVAGGSGSGNCGEVASGLTLGPPGTAHLYQGLGPVVLSGPVSHLMPFPGPLLGSPTGSFPTGPMPPTTSTTVVAPLSS

SEQ ID NO: 2429 - protein, 1039 aa, Homo sapiens
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRAEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDSGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 2430 - protein, 145 aa, Homo sapiens
MATWALLLLAAMLLGNPGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 2431 - protein, 262 aa, Homo sapiens
MRNSYRFLASSLSVVVSLLLIPEDVCEKIIGGNEVTPHSRPYMVLLSLDRKTICAGALIAKDWVLTAAHCNLNKRSQVILGAHSITREEPTKQIMLVKKEFPYPCYDPATREGDLKLLQLTEKAKINKYVTILHLPKKGDDVKPGTMCQVAGWGRTHNSASWSDTLREVNITIIDRKVCNDRNHYNFNPVIGMNMVCAGSLRGGRDSCNGDSGSPLLCEGVFRGVTSFGLENKCGDPRGPGVYILLSKKHLNWIIMTIKGAV

SEQ ID NO: 2432 - protein, 142 aa, Homo sapiens
MVLSPADKTNVKAAWGKVGAHAGEYGAEALERMFLSFPTTKTYFPHFDLSHGSAQVKGHGKKVADALTNAVAHVDDMPNALSALSDLHAHKLRVDPVNFKLLSHCLLVTLAAHLPAEFTPAVHASLDKFLASVSTVLTSKYR

SEQ ID NO: 2433 - protein, 142 aa, Homo sapiens
MSLTKTERTIIVSMWAKISTQADTIGTETLERLFLSHPQTKTYFPHFDLHPGSAQLRAHGSKVVAAVGDAVKSIDDIGGALSKLSELHAYILRVDPVNFKLLSHCLLVTLAARFPADFTAEAHAAWDKFLSVVSSVLTEKYR

SEQ ID NO: 2434 - protein, 147 aa, Homo sapiens
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRLLGNVLVCVLARNFGKEFTPQMQAAYQKVVAGVANALAHKYH

SEQ ID NO: 2435 - protein, 147 aa, Homo sapiens
MVHFTAEEKAAVTSLWSKMNVEEAGGEALGRLLVVYPWTQRFFDSFGNLSSPSAILGNPKVKAHGKKVLTSFGDAIKNMDNLKPAFAKLSELHCDKLHVDPENFKLLGNVMVIILATHFGKEFTPEVQAAWQKLVSAVAIALAHKYH

SEQ ID NO: 2436 - protein, 147 aa, Homo sapiens
MGHFTEEDKATITSLWGKVNVEDAGGETLGRLLVVYPWTQRFFDSFGNLSSASAIMGNPKVKAHGKKVLTSLGDATKHLDDLKGTFAQLSELHCDKLHVDPENFKLLGNVLVTVLAIHFGKEFTPEVQASWQKMVTAVASALSSRYH

SEQ ID NO: 2437 - protein, 142 aa, Homo sapiens
MALSAEDRALVRALWKKLGSNVGVYTTEALERTFLAFPATKTYFSHLDLSPGSSQVRAHGQKVADALSLAVERLDDLPHALSALSHLHACQLRVDPASFQLLGHCLLVTLARHYPGDFSPALQASLDKFLSHVISALVSEYR

SEQ ID NO: 2438 - protein, 260 aa, Homo sapiens
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 2439 - protein, 255 aa, Homo sapiens
MILNKALLLGALALTTVMSPCGGEDIVADHVASCGVNLYQFYGPSGQYTHEFDGDEQFYVDLERKETAWRWPEFSKFGGFDPQGALRNMAVAKHNLNIMIKRYNSTAATNEVPEVTVFSKSPVTLGQPNTLICLVDNIFPPVVNITWLSNGQSVTEGVSETSFLSKSDHSFFKISYLTFLPSADEIYDCKVEHWGLDQPLLKHWEPEIPAPMSELTETVVCALGLSVGLMGIVVGTVFIIQGLRSVGASRHQGPL

SEQ ID NO: 2440 - protein, 199 aa, Homo sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 2441 - protein, 193 aa, Homo sapiens
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 2442 - protein, 152 aa, Homo sapiens
MSRLPVLLLLQLLVRPGLQAPMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 2443 - protein, 1038 aa, Homo sapiens
MFPTESAWLGKRGANPGPEAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVRFLSKTDKRLLYCIKADPHCLNFLCNFGKMESGKEASVHIQLEGRPSILEMDETSALKFEIRATGFPEPNPRVIELNKDENVAHVLLEGLHHQRPKRYFTIVIISSSLLLGLIVLLLISYVMWKAGFFKRQYKSILQEENRRDSWSYINSKSNDD

SEQ ID NO: 2444 - protein, 1152 aa, Homo sapiens
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSPPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 2445 - protein, 798 aa, Homo sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 2446 - protein, 345 aa, Homo sapiens
MQRLVAWDPACLPLPPPPPAFKSMEVANFYYEADCLAAAYGGKAAPAAPPAARPGPRPPAGELGSIGDHERAIDFSPYLEPLGAPQAPAPATATDTFEAAPPAPAPAPASSGQHHDFLSDLFSDDYGGKNCKKPAEYGYVSLGRLGAAKGALHPGCFAPLHPPPPPPPPPAELKAEPGFEPADCKRKEEAGAPGGGAGMAAGFPYALRAYLGYQAVPSGSSGSLSTSSSSSPPGTPSPADAKAPPTACYAGAAPAPSQVKSKAKKTVDKHSDEYKIRRERNNIAVRKSRDKAKMRNLETQHKVLELTAENERLQKKVEQLSRELSTLRNLFKQLPEPLLASSGHC

SEQ ID NO: 2447 - protein, 373 aa, Homo sapiens
MSPCPPQQSRNRVIQLSTSELGEMELTWQEIMSITELQGLNAPSEPSFEPQAPAPYLGPPPPTTYCPCSIHPDSGFPLPPPPYELPASTSHVPDPPYSYGNMAIPVSKPLSLSGLLSEPLQDPLALLDIGLPAGPPKPQEDPESDSGLSLNYSDAESLELEGTEAGRRRSEYVEMYPVEYPYSLMPNSLAHSNYTLPAAETPLALEPSSGPVRAKPTARGEAGSRDERRALAMKIPFPTDKIVNLPVDDFNELLARYPLTESQLALVRDIRRRGKNKVAAQNCRKRKLETIVQLERELERLTNERERLLRARGEADRTLEVMRQQLTELYRDIFQHLRDESGNSYSPEEYALQQAADGTIFLVPRGTKMEATD

SEQ ID NO: 2448 - protein, 288 aa, Homo sapiens
MQIPQAPWPVVWAVLQLGWRPGWFLDSPDRPWNPPTFFPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 2449 - protein, 101 aa, Homo sapiens
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 2450 - protein, 706 aa, Homo sapiens
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 2451 - protein, 798 aa, Homo sapiens
MAWDMCNQDSESVWSDIECAALVGEDQPLCPDLPELDLSELDVNDLDTDSFLGGLKWCSDQSEIISNQYNNEPSNIFEKIDEENEANLLAVLTETLDSLPVDEDGLPSFDALTDGDVTTDNEASPSSMPDGTPPPQEAEEPSLLKKLLLAPANTQLSYNECSGLSTQNHANHNHRIRTNPAIVKTENSWSNKAKSICQQQKPQRRPCSELLKYLTTNDDPPHTKPTENRNSSRDKCTSKKKSHTQSQSQHLQAKPTTLSLPLTPESPNDPKGSPFENKTIERTLSVELSGTAGLTPPTTPPHKANQDNPFRASPKLKSSCKTVVPPPSKKPRYSESSGTQGNNSTKKGPEQSELYAQLSKSSVLTGGHEERKTKRPSLRLFGDHDYCQSINSKTEILINISQELQDSRQLENKDVSSDWQGQICSSTDSDQCYLRETLEASKQVSPCSTRKQLQDQEIRAELNKHFGHPSQAVFDDEADKTGELRDSDFSNEQFSKLPMFINSGLAMDGLFDDSEDESDKLSYPWDGTQSYSLFNVSPSCSSFNSPCRDSVSPPKSLFSQRPQRMRSRSRSFSRHRSCSRSPYSRSRSRSPGSRSSSRSCYYYESSHYRHRTHRNSPLYVRSRSRSPYSRRPRYDSYEEYQHERLKREEYRREYEKRESERAKQRERQRQKAIEERRVIYVGKIRPDTTRTELRDRFEVFGEIEECTVNLRDDGDSYGFITYRYTCDAFAALENGYTLRRSNETDFELYFCGRKQFFKSNYADLDSNSDDFDPASTKSKYDSLDFDSLLKEAQRSLRR

SEQ ID NO: 2452 - protein, 1043 aa, Homo sapiens
MAASFPPTLGLSSAPDEIQHPHIKFSEWKFKLFRVRSFEKTPEEAQKEKKDSFEGKPSLEQSPAVLDKADGQKPVPTQPLLKAHPKFSKKFHDNEKARGKAIHQANLRHLCRICGNSFRADEHNRRYPVHGPVDGKTLGLLRKKEKRATSWPDLIAKVFRIDVKADVDSIHPTEFCHNCWSIMHRKFSSAPCEVYFPRNVTMEWHPHTPSCDICNTARRGLKRKSLQPNLQLSKKLKTVLDQARQARQRKRRAQARISSKDVMKKIANCSKIHLSTKLLAVDFPEHFVKSISCQICEHILADPVETNCKHVFCRVCILRCLKVMGSYCPSCRYPCFPTDLESPVKSFLSVLNSLMVKCPAKECNEEVSLEKYNHHISSHKESKEIFVHINKGGRPRQHLLSLTRRAQKHRLRELKLQVKAFADKEEGGDVKSVCMTLFLLALRARNEHRQADELEAIMQGKGSGLQPAVCLAIRVNTFLSCSQYHKMYRTVKAITGRQIFQPLHALRNAEKVLLPGYHHFEWQPPLKNVSSSTDVGIIDGLSGLSSSVDDYPVDTIAKRFRYDSALVSALMDMEEDILEGMRSQDLDDYLNGPFTVVVKESCDGMGDVSEKHGSGPVVPEKAVRFSFTIMKITIAHSSQNVKVFEEAKPNSELCCKPLCLMLADESDHETLTAILSPLIAEREAMKSSELMLELGGILRTFKFIFRGTGYDEKLVREVEGLEASGSVYICTLCDATRLEASQNLVFHSITRSHAENLERYEVWRSNPYHESVEELRDRVKGVSAKPFIETVPSIDALHCDIGNAAEFYKIFQLEIGEVYKNPNASKEERKRWQATLDKHLRKKMNLKPIMRMNGNFARKLMTKETVDAVCELIPSEERHEALRELMDLYLKMKPVWRSSCPAKECPESLCQYSFNSQRFAELLSTKFKYRYEGKITNYFHKTLAHVPEIIERDGSIGAWASEGNESGNKLFRRFRKMNARQSKCYEMEDVLKHHWLYTSKYLQKFMNAHNALKTSGFTMNPQASLGDPLGIEDSLESQDSMEF

SEQ ID NO: 2453 - protein, 527 aa, Homo sapiens
MSLQMVTVSNNIALIQPGFSLMNFDGQVFFFGQKGWPKRSCPTGVFHLDVKHNHVKLKPTIFSKDSCYLPPLRYPATCTFKGSLESEKHQYIIHGGKTPNNEVSDKIYVMSIVCKNNKKVTFRCTEKDLVGDVPEARYGHSINVVYSRGKSMGALFGGRSYMPSTHRTTEKWNSVADCLPCVFLVDFEFGCATSYILPELQDGLSFHVSIAKNDTIYILGGHSLANNIRPANLYRIRVDLPLGSPAVNCTVLPGGISVSSAILTQTNNDEFVIVGGYQLENQKRMICNIISLEDNKIEIREMETPDWTPDIKHSKIWFGSNTGNGTVFLGIPGDNKQVVSEGFYFYMLKCAEDDTNEEQTTFTNSQTSTEDPGDSTPFEDSEEFCFSAEANSFDGDDEFDTYNEDDEEDESETGYWITCCPTCDVDINTWVPFYSTELNKPAMIYCSHGDGHWVHAQCMDLAERTLIHLSAGSNKYYCNEHVEIARALHTPQRVLPLKKPPMKSLRKKGSGKILTPAKKSFLRRLFD

SEQ ID NO: 2454 - protein, 93 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 2455 - protein, 277 aa, Homo sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 2456 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 2457 - protein, 275 aa, Homo sapiens [sequence omitted]

SEQ ID NO: 2458 - protein, 363 aa, Homo sapiens
MAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKNYQQQTVVAIDLAGDETIPGSSLLPGHVQAYQEAVKSGIHRTVHAGEVGSAEVVKEAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNL

SEQ ID NO: 2459 - protein, 443 aa, Homo sapiens
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKVIIPEKSQNFSALKKDILLPFQGQLDSIPVSNPSCPMIPLYRNLPDHSAATKPSLFLFLVSLLHIFFK

SEQ ID NO: 2460 - protein, 144 aa, Homo sapiens
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 2461 - protein, 204 aa, Homo sapiens
MAGPATQSPMKLMALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 2462 - protein, 224 aa, Homo sapiens
MEKLLCFLVLTSLSHAFGQTDMSRKAFVFPKESDTSYVSLKAPLTKPLKAFTVCLHFYTELSSTRGTVFSRMPPRDKTMRFFIFWSKDIGYSFTVGGSEILFEVPEVTVAPVHICTSWESASGIVEFWVDGKPRVRKSLKKGYTVGAEASIILGQEQDSFGGNFEGSQSLVGDIGNVNMWDFVLSPDEINTIYLGGPFSPNVLNWRALKYEVQGEVFTKPQLWP

SEQ ID NO: 2463 - protein, 993 aa, Homo sapiens
MPALARDAGTVPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVGKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 2464 - protein, 443 aa, Homo sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 2465 - protein, 459 aa, Homo sapiens
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMDPILLTISILSFFSVALLVILACVLWKKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 2466 - protein, 362 aa, Homo sapiens
MATAETALPSISTLTALGPFPDTQDDFLKWWRSEEAQDMGPGPPDPTEPPLHVKSEDQPGEEEDDERGADATWDLDLLLTNFSGPEPGGAPQTCALAPSEASGAQYPPPPETLGAYAGGPGLVAGLLGSEDHSGWVRPALRARAPDAFVGPALAPAPAPEPKALALQPVYPGPGAGSSGGYFPRTGLSVPAASGAPYGLLSGYPAMYPAPQYQGHFQLFRGLQGPAPGPATSPSFLSCLGPGTVGTGLGGTAEDPGVIAETAPSKRGRRSWARKRQAAHTCAHPGCGKSYTKSSHLKAHLRTHTGEKPYACTWEGCGWRFARSDELTRHYRKHTGQRPFRCQLCPRAFSRSDHLALHMKRHL

SEQ ID NO: 2467 - protein, 509 aa, Homo sapiens
MGCGCSSHPEDDWMENIDVCENCHYPIVPLDGKGTLLIRNGSEVRDPLVTYEGSNPPASPLQDNLVIALHSYEPSHDGDLGFEKGEPLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 2468 - protein, 399 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 2469 - protein, 335 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 2470 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 2471 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 2472 - protein, 247 aa, Homo sapiens
MQPILLLLAFLLLPRADAGEIIGGHEAKPHSRPYMAYLMIWDQKSLKRCGGFLIQDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 2473 - protein, 281 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 2474 - protein, 830 aa, Homo sapiens
MGSMFRSEEVALVQLFLPTAAAYTCVSRLGELGLVEFRDLNASVSAFQRRFVVDVRRCEELEKTFTFLQEEVRRAGLVLPPPKGRLPAPPPRDLLRIQEETERLAQELRDVRGNQQALRAQLHQLQLHAAVLRQGHEPQLAAAHTDGASERTPLLQAPGGPHQDLRVNFVAGAVEPHKAPALERLLWRACRGFLIASFRELEQPLEHPVTGEPATWMTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 2475 - protein, 555 aa, Homo sapiens
MAARLLLLGILLLLLPLPVPAPCHTAARSECKRSHKFVPGAWLAGEGVDVTSLRRSGSFPVDTQRFLRPDGTCTLCENALQEGTLQRLPLALTNWRAQGSGCQRHVTRAKVSSTEAVARDAARSIRNDWKVGLDVTPKPTSNVHVSVAGSHSQAANFAAQKTHQDQYSFSTDTVECRFYSFHVVHTPPLHPDFKRALGDLPHHFNASTQPAYLRLISNYGTHFIRAVELGGRISALTALRTCELALEGLTDNEVEDCLTVEAQVNIGIHGSISAEAKACEEKKKKHKMTASFHQTYRERHSEVVGGHHTSINDLLFGIQAGPEQYSAWVNSVPGSPGLVDYTLEPLHVLLDSQDPRREALRRALSQYLTDRARWRDCSRPCPPGRQKSPRDPCQCVCHGSAVTTQDCCPRQRGLAQLEVTFIQAWSLWGDWFTATDAYVKLFFGGQELRTSTVWDNNNPIWSVRLDFGDVLLATGGPLRLQVWDQDSGRDDDLLGTCDQAPKSGSHEVRCNLNHGHLKFRYHARCLPHLGGGTCLDYVPQMLLGEPPGNRSGAVW

SEQ ID NO: 2476 - protein, 153 aa, Homo sapiens [sequence omitted]

SEQ ID NO: 2477 - protein, 146 aa, Homo sapiens
MHPLLNPLLLALGLMALLLTTVIALTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFN

SEQ ID NO: 2478 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 2479 - protein, 235 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 2480 - protein, 181 aa, Homo sapiens
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQAL

SEQ ID NO: 2481 - protein, 147 aa, Homo sapiens
MVHLTPEEKSAVTALWGKVNVDEVGGEALGRLLVVYPWTQRFFESFGDLSTPDAVMGNPKVKAHGKKVLGAFSDGLAHLDNLKGTFATLSELHCDKLHVDPENFRLLGNVLVCVLAHHFGKEFTPPVQAAYQKVVAGVANALAHKYH

SEQ ID NO: 2482 - protein, 259 aa, Homo sapiens
MSKYKLIMLRHGEGAWNKENRFCSWVDQKLNSEGMEEARNCGKQLKALNFEFDLVFTSVLNRSIHTAWLILEELGQEWVPVESSWRLNERHYGALIGLNREQMALNHGEEQVRLWRRSYNVTPPPIEESHPYYQEIYNDRRYKVCDVPLDQLPRSESLKDVLERLLPYWNERIAPEVLRGKTILISAHGNSSRALLKHLEGISDEDIINITLPTGVPILLELDENLRAVGPHQFLGDQEAIQAAIKKVEDQGKVKQAKK

SEQ ID NO: 2483 - protein, 344 aa, Homo sapiens
MSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 2484 - protein, 808 aa, Homo sapiens
MAELLASAGSACSWDFPRAPPSFPPPAASRGGLGGTRSFRPHRGAESPRPGRDRDGVRVPMASSRCPAPRGCRCLPGASLAWLGTVLLLLADWVLLRTALPRIFSLLVPTALPLLRVWAVGLSRWAVLWLGACGVLRATVGSKSENAGAQGWLAALKPLAAALGLALPGLALFRELISWGAPGSADSTRLLHWGSHPTAFVVSYAAALPAAALWHKLGSLWVPGGQGGSGNPVRRLLGCLGSETRRLSLFLVLVVLSSLGEMAIPFFTGRLTDWILQDGSADTFTRNLTLMSILTIASAVLEFVGDGIYNNTMGHVHSHLQGEVFGAVLRQETEFFQQNQTGNIMSRVTEDTSTLSDSLSENLSLFLWYLVRGLCLLGIMLWGSVSLTMVTLITLPLLFLLPKKVGKWYQLLEVQVRESLAKSSQVAIEALSAMPTVRSFANEEGEAQKFREKLQEIKTLNQKEAVAYAVNSWTTSISGMLLKVGILYIGGQLVTSGAVSSGNLVTFVLYQMQFTQAVEVLLSIYPRVQKAVGSSEKIFEYLDRTPRCPPSGLLTPLHLEGLVQFQDVSFAYPNRPDVLVLQGLTFTLRPGEVTALVGPNGSGKSTVAALLQNLYQPTGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 2485 - protein, 453 aa, Homo sapiens
MARKVVSRKRKAPASPGAGSDAQGPQFGWDHSLHKRKRLPPVKRSLVYYLKNREVRLQNETSYSRVLHGYAAQQLPSLLKEREFHLGTLNKVFASQWLNHRQVVCGTKCNTLFVVDVQTSQITKIPILKDREPGGVTQQGCGIHAIELNPSRTLLATGGDNPNSLAIYRLPTLDPVCVGDDGHKDWIFSIAWISDTMAVSGSRDGSMGLWEVTDDVLTKSDARHNVSRVPVYAHITHKALKDIPKEDTNPDNCKVRALAFNNKNKELGAVSLDGYFHLWKAENTLSKLLSTKLPYCRENVCLAYGSEWSVYAVGSQAHVSFLDPRQPSYNVKSVCSRERGSGIRSVSFYEHIITVGTGQGSLLFYDIRAQRFLEERLSACYGSKPRLAGENLKLTTGKGWLNHDETWRNYFSDIDFFPNAVYTHCYDSSGTKLFVAGGPLPSGLHGNYAGLWS

SEQ ID NO: 2486 - protein, 352 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 2487 - protein, 199 aa, Homo sapiens
MSSENCFVAENSSLHPESGQENDATSPHFSTRHEGSFQVPVLCAVMNVVFITILIIALIALSVGQYNCPGQYTFSMPSDSHVSSCSEDWVGYQRKCYFISTVKRSWTSAQNACSEHGATLAVIDSEKDMNFLKRYAGREEHWVGLKKEPGHPWKWSNGKEFNNWFNVTGSDKCVFLKNTEVSSMECEKNLYWICNKPYK

SEQ ID NO: 2488 - protein, 91 aa, Homo sapiens
MKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 2489 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 2490 - protein, 153 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 2491 - protein, 231 aa, Homo sapiens
MQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTVLCQSEWLKYQGKCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 2492 - protein, 512 aa, Homo sapiens
MGCIKSKGKDSLSDDGVDLKTQPVRNTERTIYVRDPTSNKQQRPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSAGAFLIRESETLKGSFSLSVRDFDPVHGDVIKHYKIRSLDNGGYYISPRITFPCISDMIKHYQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 2493 - protein, 272 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 2494 - protein, 92 aa, Homo sapiens
MKLCVTVLSLLMLVAAFCSPALSAPMGSDPPTACCFSYTARKLPRNFVVDYYETSSLCSQPAVVFQTKRSKQVCADPSESWVQEYVYDLELN

SEQ ID NO: 2495 - protein, 532 aa, Homo sapiens
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNNPAENSPNHRPYTASDFIEGIYRTERDKGTLYELTFKGDHKHEFKRLILFRPFGPIMKVKNEKLNMANTLINVIVPLAKRVDKFRQFMQNFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 2496 - protein, 125 aa, Homo sapiens
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 2497 - protein, 98 aa, Homo sapiens
MNQTAILICCLIFLTLSGIQGVPLSRTVRCTCISISNQPVNPRSLEKLEIIPASQFCPRVEIIATMKKKGEKRCLNPESKAIKNLLKAVSKEMSKRSP

SEQ ID NO: 2498 - protein, 155 aa, Homo sapiens
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 2499 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 2500 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 2501 - protein, 166 aa, Homo sapiens
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFQGRRASQ

SEQ ID NO: 2502 - protein, 266 aa, Homo sapiens
MVCLKLPGGSCMTALTVTLMVLSSPLALAGDTRPRFLWQLKFECHFFNGTERVRLLERCIYNQEESVRFDSDVGEYRAVTELGRPDAEYWNSQKDLLEQRRAAVDTYCRHNYGVGESFTVQRRVEPKVTVYPSKTQPLQHHNLLVCSVSGFYPGSIEVRWFRNGQEEKAGVVSTGLIQNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 2503 - protein, 210 aa, Homo sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 2504 - protein, 458 aa, Homo sapiens
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 2505 - protein, 368 aa, Homo sapiens
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 2506 - protein, 107 aa, Homo sapiens
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 2507 - protein, 558 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 2508 - protein, 323 aa, Homo sapiens
MWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVASNQKTIQPPRKAVEEPLNAFKESKGMMNDE

SEQ ID NO: 2509 - protein, 362 aa, Homo sapiens
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPSGEEQRYTCHVQHEGLPQPLILRWEQSPQPTIPIVGIVAGLVVLGAVVTGAVVAAVMWRKKSSDRNRGSYSQAAVTDSAQGSGVSLTANKV

SEQ ID NO: 2510 - protein, 604 aa, Homo sapiens
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKGKKQLPDSNEIVEKLLLRRKFIPDPQGSNMMFAFFAQHFTHQFFKTDHKRGPAFTNGLGHGVDLNHIYGETLARQRKLRLFKDGKMKYQIIDGEMYPPTVKDTQAEMIYPPQVPEHLRFAVGQEVFGLVPGLMMYATIWLREHNRVCDVLKQEHPEWGDEQLFQTSRLILIGETIKIVIEDYVQHLSGYHFKLKFDPELLFNKQFQYQNRIAAEFNTLYHWHPLLPDTFQIHDQKYNYQQFIYNNSILLEHGITQFVESFTRQIAGRVAGGRNVPPAVQKVSQASIDQSRQMKYQSFNEYRKRFMLKPYESFEELTGEKEMSAELEALYGDIDAVELYPALLVEKPRPDAIFGETMVEVGAPFSLKGLMGNVICSPAYWKPSTFGGEVGFQIINTASIQSLICNNVKGCPFTSFSVPDPELIKTVTINASSSRSGLDDINPTVLLKERSTEL

SEQ ID NO: 2511 - protein, 343 aa, Homo sapiens
MPLCSLLTCLGLNVLFLTLNEGAWYSVGALMISVPALLGYLQEVCRARLPDSELMRRKYHSVRQEDLQRVRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEETHLVVLEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 2512 - protein, 789 aa, Homo sapiens
MKMDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 2513 - protein, 381 aa, Homo sapiens
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKPVSPLLLASGMARDWPDARGIWHNDNKTFLVWVNEEDHLRVISMQKGGNMKEVFTRFCTGLTQIETLFKSKDYEFMWNPHLGYILTCPSNLGTGLRAGVHIKLPNLGKHEKFSEVLKRLRLQKRGTGGVDTAAVGGVFDVSNADRLGFSEVELVQMVVDGVKLLIEMEQRLEQGQAIDDLMPAQK

SEQ ID NO: 2514 - protein, 541 aa, Homo sapiens
MTTPAGSGSGFGSVSWWGLSPALDLQAESPPVDPDSQADTVHSNPELDVLLLGSVDGRHLLRTLSRAKFWPRRRFNFFVLENNLEAVARHMLIFSLALEEPEKMGLQERSETFLEVWGNALLRPPVAAFVRAQADLLAHLVPEPDRLEEQLPWLSLRALKFRERDALEAVFRFWAGGEKGPQAFPMSRLWDSRLRHYLGSRYDARRGVSDWDLRMKLHDRGAQVIHPQEFRRWRDTGVAFELRDSSAYHVPNRTLASGRLLSYRGERVAARGYWGDIATGPFVAFGIEADDESLLRTSNGQPVKTAGEITQHNVTELLRDVAAWGRARATGGDLEEQQHAEGSPEPGTPAAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 2515 - protein, 288 aa, Homo sapiens
MSDIEEVVEEYEEEEQEEAAVEEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKQAQTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 2516 - protein, 154 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 2517 - protein, 501 aa, Homo sapiens
MVRKPVVSTISKGGYLQGNVNGRLPSLGNKEPPGQEKVQLKRKVTLLRGVSIIIGTIIGAGIFISPKGVLQNTGSVGMSLTIWTVCGVLSLFGALSYAELGTTIKKSGGHYTYILEVFGPLPAFVRVWVELLIIRPAATAVISLAFGRYILEPFFIQCEIPELAIKLITAVGITVVMVLNSMSVSWSARIQIFLTFCKLTAILIIIVPGVMQLIKGQTQNFKDAFSGRDSSITRLPLAFYYGMYAYAGWFYLNFVTEEVENPEKTIPLAICISMAIVTIGYVLTNVAYFTTINAEELLLSNAVAVTFSERLLGNFSLAVPIFVALSCFGSMNGGVFAVSRLFYVASREGHLPEILSMIHVRKHTPLPAVIVLHPLTMIMLFSGDLDSLLNFLSFARWLFIGLAVAGLIYLRYKCPDMHRPFKVPLFIPALFSFTCLFMVALSLYSDPFSTGIGFVITLTGVPAYYLFIIWDKKPRWFRIMSEKITRTLQIILEVVPEEDKL

SEQ ID NO: 2518 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 2519 - protein, 260 aa, Homo sapiens
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 2520 - protein, 329 aa, Homo sapiens
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 2521 - protein, 132 aa, Homo sapiens; identical to SEQ ID NO: 2406

SEQ ID NO: 2522 - protein, 491 aa, Homo sapiens
MESSAKRKMDPDNPDEGPSSKVPRPETPVTKATTFLQTMLRKEVNSQLSLGDPLFPELAEESLKTFEQVTEDCNENPEKDVLAELVKQIKVRVDMVRHRIKEHMLKKYTQTEEKFTGAFNMMGGCLQNALDILDKVHEPFEEMKCIGLTMQSMYENYIVPEDKREMWMACIKELHDVSKGAANKLGGALQAKARAKKDELRRKMMYMCYRNIEFFTKNSAFPKTTNGCSQAMAALQNLPQCSPDEIMAYAQKIFKILDEERDKVLTHIDHIFMDILTTCVETMCNEYKVTSDACMMTMYGGISLLSEFCRVLCCYVLEETSVMLAKRPLITKPEVISVMKRRIEEICMKVFAQYILGADPLRVCSPSVDDLRAIAEESDEEEAIVAYTLATAGVSSSDSLVSPPESPVPATIPLSSVIVAENSDQEESEQSDEEEEEGAQEEREDTVSVKSEPVSEIEEVAPEEEEDGAEEPTASGGKSTHPMVTRSKADQ

SEQ ID NO: 2523 - protein, 491 aa, Homo sapiens; identical to SEQ ID NO: 2522

SEQ ID NO: 2524 - protein, 641 aa, Homo sapiens
MSDEGPGTGPGNGLGEKGDTSGPEGSGGSGPQRRGGDNHGRGRGRGRGRGGGRPGAPGGSGSGPRHRDGVRRPQKRPSCIGCKGTHGGTGAGAGAGGAGAGGAGAGGGAGAGGGAGGAGGAGGAGAGGGAGAGGGAGGAGGAGAGGGAGAGGGAGGAGAGGGAGGAGGAGAGGGAGAGGGAGGAGAGGGAGGAGGAGAGGGAGAGGAGGAGGAGAGGAGAGGGAGGAGGAGAGGAGAGGAGAGGAGAGGAGGAGAGGAGGAGAGGAGGAGAGGGAGGAGAGGGAGGAGAGGAGGAGAGGAGGAGAGGAGGAGAGGGAGAGGAGAGGGGRGRGGSGGRGRGGSGGRGRGGSGGRRGRGRERARGGSRERARGRGRGRGEKRPRSPSSQSSSSGSPPRRPPPGRRPFFHPVGEADYFEYHQEGGPDGEPDVPPGAIEQGPADDPGEGPSTGPRGQGDGGRRKKGGWFGKHRGQGGSNPKFENIAEGLRALLARSHVERTTDEGTWVAGVFVYGGSKTSLYNLRRGTALAIPQCRLTPLSRLPFGMAPGPGPQPGPLRESIVCYFMVFLQTHIFAEVLKDAIKDLVMTKPAPTCNIRVTVCSFDDGVDLPPWFPPMVEGAAAEGDDGDDGDEGGDGDEGEEGQE

SEQ ID NO: 2525 - protein, 245 aa, Homo sapiens
MMDPNSTSEDVKFTPDPYQVPFVQAFDQATRVYQDLGGPSQAPLPCVLWPVLPEPLPQGQLTAYHVSTAPTGSWFSAPQPAPENAYQAYAAPQLFPVSDITQNQQTNQAGGEAPQPGDNSTVQTAAAVVFACPGANQGQQLADIGVPQPAPVAAPARRTRKPQQPESLEECDSELEIKRYKNRVASRKCRAKFKQLLQHYREVAAAKSSENDRLRLLLKQMCPSLDVDSIIPRTPDVLHEDLLNF

SEQ ID NO: 2526 - protein, 491 aa, Homo sapiens; identical to SEQ ID NO: 2522

SEQ ID NO: 2527 - protein, 491 aa, Homo sapiens; identical to SEQ ID NO: 2522

SEQ ID NO: 2528 - protein, 142 aa, Homo sapiens
MSLLPVPYTEAASLSTGSTVTIKGRPLACFLNEPYLQVDFHTEMKEESDIVFHFQVCFGRRVVMNSREYGAWKQQVESKNMPFQDGQEFELSISVLPDKYQVMVNGQSSYTFDHRIKPEAVKMVQVWRDISLTKFNVSYLKR

SEQ ID NO: 2529 - protein, 298 aa, Homo sapiens
MAEAMDLGKDPNGPTHSSTLFVRDDGSSMSFYVRPSPAKRRLSTLILHGGGTVCRVQEPGAVLLAQPGEALAEASGDFISTQHILDCVERNERLELEAYRLGPASAADTGSEAKPGALAEGAAEPEPQRHAGRIAFTDADDVAILTYVKENARSPSSVTGNALWKAMEKSSLTQHSWQSLKDRYLKHLRGQEHKYLLGDAPVSPSSQKLKRKAEEDPEAADSGEPQNKRTPDLPEEEYVKEEIQENEEAVKKMLVEATREFEEVVVDESPPDFEIHITMCDDDPPTPEEDSETQPDEE

SEQ ID NO: 2530 - protein, 365 aa, Homo sapiens
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 2531 - protein, 155 aa, Homo sapiens
MELRSGSVGSQAVARRMDGDSRDGGGGKDATGSEDYENLPTSASVSTHMTAGAMAGILEHSVMYPVDSVKTRMQSLSPDPKAQYTSIYGALKKIMRTEGFWRPLRGVNVMIMGAGPAHAMYFACYENMKRTLNDVFHHQGNSHLANGILKAFVWS

SEQ ID NO: 2532 - protein, 384 aa, Homo sapiens
MKVTSLDGRQLRKMLRKEAAARCVVLDCRPYLAFAASNVRGSLNVNLNSVVLRRARGGAVSARYVLPDEAARARLLQEGGGGVAAVVVLDQGSRHWQKLREESAARVVLTSLLACLPAGPRVYFLKGGYETFYSEYPECCVDVKPISQEKIESERALISQCGKPVVNVSYRPAYDQGGPVEILPFLYLGSAYHASKCEFLANLHITALLNVSRRTSEACMTHLHYKWIPVEDSHTADISSHFQEAIDFIDCVREKGGKVLVHCEAGISRSPTICMAYLMKTKQFRLKEAFDYIKQRRSMVSPNFGFMGQLLQYESEILPSTPNPQPPSCQGEAAGSSLIGHLQTLSPDMQGAYCTFPASVLAPVPTHSTVSELSRSPVATATSC

SEQ ID NO: 2533 - protein, 99 aa, Homo sapiens
MAQGKVASLGPIKQHTFLKNMGIDVRLKVLLDKSNEPSVRQQLLQGYDMLMNPKKMGERFNFFALLPHQRLQGGRYQRNARQSKPFASVVAGFSELAWQ

SEQ ID NO: 2534 - protein, 529 aa, Homo sapiens
MGSSRAPWMGRVGGHGMMALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGSSGSHSGSSSSHSSSSSSFQFSSSSFQVGNGSALPTNDNSYRGILNPSQPGQSSSSSQTSGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSSGSPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLDSP

SEQ ID NO: 2535 - protein, 125 aa, Homo sapiens [sequence omitted]

SEQ ID NO: 2536 - protein, 335 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 2537 - protein, 114 aa, Homo sapiens
MASVSELACIYSALILHDDEVTVTEDKINALIKAAGVNVEPFWPGLFAKALANVNIGSLICNVGAGGPAPAAGAAPAGGPAPSTAAAPAEEKKVEAKKEESEESDDDMGFGLFD

SEQ ID NO: 2538 - protein, 142 aa, Homo sapiens
MAAGGSDPRAGDVEEDASQLIFPKEFETAETLLNSEVHMLLEHRKQQNESAEDEQELSEVFMKTLNYTARFSRFKNRETIASVRSLLLQKKLHKFELACLANLCPETAEESKALIPSLEGRFEDEELQQILDDIQTKRSFQY

SEQ ID NO: 2539 - protein, 178 aa, Homo sapiens [sequence omitted]

SEQ ID NO: 2540 - protein, 351 aa, Homo sapiens
METNFSTPLNEYEEVSYESAGYTVLRILPLVVLGVTFVLGVLGNGLVIWVAGFRMTRTVTTICYLNLALADFSFTATLPFLIVSMAMGEKWPFGWFLCKLIHIVVDINLFGSVFLIGFIALDRCICVLHPVWAQNHRTVSLAMKVIVGPWILALVLTLPVFLFLTTVTIPNGDTYCTFNFASWGGTPEERLKVAITMLTARGIIRFVIGFSLPMSIVAICYGLIAAKIHKKGMIKSSRPLRVLTAVVASFFICWFPFQLVALLGTVWLKEMLFYGKYKIIDILVNPTSSLAFFNSCLNPMLYVFVGQDFRERLIHSLPTSLERALSEDSAPTNDTAANSASPPAETELQAM

SEQ ID NO: 2541 - protein, 349 aa, Homo sapiens
METPPVNTIGEKDTSQPQQEWEKNLRENLDSVIQIRQQPRDPPTETLELEVSPDPASQILEHTQGAEKLVAELEGDSHKSHGSTSQMPEALQASDLWYCPDGSFVKKIVIRGHGLDKPKLGSCCRVLALGFPFGSGPPEGWTELTMGVGPWREETWGELIEKCLESMCQGEEAELQLPGHSGPPVRLTLASFTQGRDSWELETSEKEALAREERARGTELFRAGNPEGAARCYGRALRLLLTLPPPGPPERTVLHANLAACQLLLGQPQLAAQSCDRVLEREPGHLKALYRRGVAQAALGNLEKATADLKKVLAIDPKNRAAQEELGKVVIQGKNQDAGLAQGLRKMFG

SEQ ID NO: 2542 - protein, 417 aa, Homo sapiens
MGRRRAPELYRAPFPLYALQVDPSTGLLIAAGGGGAAKTGIKNGVHFLQLELINGRLSASLLHSHDTETRATMNLALAGDILAAGQDAHCQLLRFQAHQQQGNKAEKAGSKEQGPRQRKGAAPAEKKCGAETQHEGLELRVENLQAVQTDFSSDPLQKVVCFNHDNTLLATGGTDGYVRVWKVPSLEKVLEFKAHEGEIEDLALGPDGKLVTVGRDLKASVWQKDQLVTQLHWQENGPTFSSTPYRYQACRFGQVPDQPAGLRLFTVQIPHKRLRQPPPCYLTAWDGSNFLPLRTKSCGHEVVSCLDVSESGTFLGLGTVTGSVAIYIAFSLQCLYYVREAHGIVVTDVAFLPEKGRGPELLGSHETALFSVAVDSRCQLHLLPSRRSVPVWLLLLLCVGLIIVTILLLQSAFPGFL

SEQ ID NO: 2543 - protein, 309 aa, Homo sapiens
MRQNDKIMCILENRKKRDRKNLCRAINDFQQSFQKPETRREFDLSDPLALKKDLPARQSDNDVRNTISGMQKFMGEDLNFHERKKFQEEQNREWSLQQQREWKNARAEQKCAEALYTETRLQFDETAKHLQKLESTTRKAVCASVKDFNKSQAIESVERKKQEKKQEQEDNLAEITNLLRGDLLSENPQQAASSFGPHRVVPDRWKGMTQEQLEQIRLVQKQQIQEKLRLQEEKRQRDLDWDRRRIQGARATLLFERQQWRRQRDLRRALDSSNLSLAKEQHLQKKYMNEVYTNQPTGDYFTQFNTGSR

SEQ ID NO: 2544 - protein, 838 aa, Homo sapiens
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCVDCLRQYLRIEISESRVNISCPECTERFNPHDIRLILSDDVLMEKYEEFMLRRWLVADPDCRWCPAPDCGYAVIAFGCASCPKLTCGREGCGTEFCYHCKQIWHPNQTCDAARQERAQSLRLRTIRSSSISYSQESGAAADDIKPCPRCAAYIIKMNDGSCNHMTCAVCGCEFCWLCMKEISDLHYLSPSGCTFWGKKPWSRKKKILWQLGTLVGAPVGIALIAGIAIPAMIIGIPVYVGRKIHNRYEGKDVSKHKRNLAIAGGVTLSVIVSPVVAAVTVGIGVPIMLAYVYGVVPISLCRSGGCGVSAGNGKGVRIEFDDENDINVGGTNTAVDTTSVAEARHNPSIGEGSVGGLTGSLSASGSHMDRIGAIRDNLSETASTMALAGASITGSLSGSAMVNCFNRLEVQADVQKERYSLSGESGTVSLGTVSDNASTKAMAGSILNSYIPLDKEGNSMEVQVDIESKPSKFRHNSGSSSVDDGSATRSYAGGSSSGLPEGKSSATKWSKEATAGKKSKSGKLRKKGNMKINETREDMDAQLLEQQSTNSSEFEAPSLSDSMPSVADSHSSHFSEFSCSDLESMKTSCSHGSSDYHTRFATVNILPEVENDRLENSPHQCSISVVTQTASCSEVSQLNHIAEEHGNNGIKPNVDLYFGDALKETNNNHSHQTMELKVAIQTEI

SEQ ID NO: 2545 - protein, 1539 aa, Homo sapiens [sequence omitted]

SEQ ID NO: 2546 - protein, 274 aa, Homo sapiens
MGVSAQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDGEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLREARAGFNSSSTCGCAHPSHQARWPMVV

SEQ ID NO: 2547 - protein, 504 aa, Homo sapiens
MVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVLKSNPSENEEKEAQSQLIKSDEMQRLRSQALNAFGSGDYTAAIAFLDKILEVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 2548 - protein, 258 aa, Homo sapiens
MPPQQGDPAFPDRCEAPPVPPRRERGGRGGRGPGEPGGRGRAGGAEGRGVKCVLVGDGAVGKTSLVVSYTTNGYPTEYIPTAFDNFSAVVSVDGRPVRLQLCDTAGQDEFDKLRPLCYTNTDIFLLCFSVVSPSSFQNVSEKWVPEIRCHCPKAPIILVGTQSDLREDVKVLIELDKCKEKPVPEEAAKLCAEEIKAASYIECSALTQKNLKEVFDAAIVAGIQYSDTQQQPKKSKSRTPDKMKNLSKSWWKKYCCFV

SEQ ID NO: 2549 - protein, 394 aa, Homo sapiens
MFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDCGKSYRSFSNLWKHRKTHQQQHQAAVRQQLAEAEAAVGLAVMETAVEALPLVEAIEIYPLAEAEGVQISG

SEQ ID NO: 2550 - protein, 415 aa, Homo sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILELPYAGDVSMFLLLPDEIADVSTGLELLESEITYDKLNKWTSKDKMAEDEVEVYIPQFKLEEHYELRSILRSMGMEDAFNKGRANFSGMSERNDLFLSEVFHQAMVDVNEEGTEAAAGTGGVMTGRTGHGGPQFVADHPFLFLIMHKITNCILFFGRFSSP

SEQ ID NO: 2551 - protein, 434 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 2552 - protein, 281 aa, Homo sapiens
MEVHQQNALFQYFADTLTAVVQNAKKNGRYDMGILDLGSGDEKVRKSDVKKFLTPGYSTSGHVELYTISVERGMSWEEATKIWAELTGPDDGFYLSLQIRNNKKTAILVKEVNPKKKLFLVYRPNTGKQLKLEIYADLKKKYKKVVSDDALMHWLDQYNSSADTCTHAYWRGNCKKASLGLVCEIGLRCRTYYVLCGSVLSVWTKVEGVLASVSGTNVKMQIVRLRTEDGQRIVGLIIPANCVSPLVNLLSTSDQSQQLAVQQKQLWQQHHPQSITNLSNA

SEQ ID NO: 2553 - protein, 176 aa, Homo sapiens [sequence omitted]

SEQ ID NO: 2554 - protein, 363 aa, Homo sapiens
MALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFRRLLPRVQMVKKRLHPDEVVIADCAFDLVNIHLFHDASNLVAWETSPSVYSGIRHKALGYVLDRIIDQRFEKVSYFVFGDFNFRLDSKSVVETLSAKPPMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRSESEEKVVTYDHIGPNVCMGDHKPVFLAFRIMPGAGKPHAHVHKCCVVQ

SEQ ID NO: 2555 - protein, 56 aa, Homo sapiens [sequence omitted]

SEQ ID NO: 2556 - protein, 520 aa, Homo sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTMLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 2557 - protein, 564 aa, Homo sapiens
MSAGSATHPGAGGRRSKWDQPAPAPLLFLPPAAPGGEVTSSGGSPGGTTAAPSGALDAAAAVAAKINAMLMAKGKLKPTQNASEKLQAPGKGLTSNKSKDDLVVAEVEINDVPLTCRNLLTRGQTQDEISRLSGAAVSTRGRFMTTEEKAKVGPGDRPLYLHVQGQTRELVDRAVNRIKEIITNGVVKAATGTSPTFNGATVTVYHQPAPIAQLSPAVSQKPPFQSGMHYVQDKLFVGLEHAVPTFNVKEKVEGPGCSYLQHIQIETGAKVFLRGKGSGCIEPASGREAFEPMYIYISHPKPEGLAAAKKLCENLLQTVHAEYSRFVNQINTAVPLPGYTQPSAISSVPPQPPYYPSNGYQSGYPVVPPPQQPVQPPYGVPSIVPPAVSLAPGVLPALPTGVPPVPTQYPITQVQPPASTGQSPMGGPFIPAAPVKTALPAGPQPQPQPQPPLPSQPQAQKRRFTEELPDERESGLLGYQHGPIHMTNLGTGFSSQNEIEGAGSKPASSSGKERERDRQLMPPPAFPVTGIKTESDERNGSGTLTGSHGECDIAGGTGEWLRLV

SEQ ID NO: 2558 - protein, 462 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 2559 - protein, 394 aa, Homo sapiens
MSGEDEQQEQTIAEDLVVTKYKMGGDIANRVLRSLVEASSSGVSVLSLCEKGDAMIMEETGKIFKKEKEMKKGIAFPTSISVNNCVCHFSPLKSDQDYILKEGDLVKIDLGVHVDGFIANVAHTFVVDVAQGTQVTGRKADVIKAAHLCAEAALRLVKPGNQNTQVTEAWNKVAHSFNCTPIEGMLSHQLKQHVIDGEKTIIQNPTDQQKKDHEKAEFEVHEVYAVDVLVSSGEGKAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKASKTAENPTSGETLEENEAGD

SEQ ID NO: 2560 - protein, 335 aa, Homo sapiens; identical to SEQ ID NO: 2536

SEQ ID NO: 2561 - protein, 1912 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEDDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 2562 - protein, 345 aa, Homo sapiens
MPQRPAASNIPVVGSPNPPSTHFASQNQHSYSSPPWAGQHNRKGEKNGMGLCRLSMKVWETVQRKGTTSCQEVVGELVAKFRAASNHASPNESAYDVKNIKRRTYDALNVLMAMNIISREKKKIKWIGLTTNSAQNCQNLRVERQKRLERIKQKQSELQQLILQQIAFKNLVLRNQYVEEQVSQRPLPNSVIHVPFIIISSSKKTVINCSISDDKSEYLFKFNSSFEIHDDTEVLMWMGMTFGLESGSCSAEDLKMARNLVPKALEPYVTEMAQGTFGGVFTTAGSRSNGTWLSASDLTNIAIGMLATSSGGSQYSGSRVETPAVEEEEEEDNNDDDLSENDEDD

SEQ ID NO: 2563 - protein, 553 aa, Homo sapiens
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQTILEEDVEDPVYQYIVFEAGHEPIRDPETEENIYQVPTSQKKEGVYDVPKSQPAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 2564 - protein, 1336 aa, Homo sapiens
MENLPAVTTEEPTPMGRGPVGPSGGGSTRDQVRTVVMRPSVSWEKAGPEEAKAPVRGDEAPPARVAGPAAGTPPCQMGVYPTDLTLQLLAVRRKSRLRDPGLQQTLRGQLRLLENDSREMARVLGELSARLLSIHSDQDRIVVTFKTFEEIWKFSTYHALGFTHHCLANLLMDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSPEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALRGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSPACKVADKVLEGQLLETISQLYLSLGTERAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 2565 - protein, 93 aa, Homo sapiens
MLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 2566 - protein, 1186 aa, Homo sapiens
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKRKTQKRGITNTLEESSSLKRKRLSDSKRKNTCGGFLGETCLSESSDGSSSEHAESSSLMNVQRRTAAKEPKTSASDSQNSVKEAPVKNGGATTSSSSDSDDDGGKEKMVLVTARSVFGKKRRKLRRARGRKRKT

SEQ ID NO: 2567 - protein, 84 aa, Homo sapiens
MPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 2568 - protein, 691 aa, Homo sapiens
MDGCKKELPRLQEPEEDEDCYILNVQSSSDDTSGSSVARRAPKRQASCILNVQSRSGDTSGSSVARRAPKRQASSVVVIDSDSDEECHTHEEKKAKLLEINSDDESPECCHVKPAIQEPPIVISDDDNDDDNGNDLEVPDDNSDDSEAPDDNSDDSEAPDDNSDDSEAPDDNSDDSEAPDDNSDDSDVPDDNSDDSSDDNSDDSSDDNSDDSDVPDDKSDDSDVPDDSSDDSDVPDDSSDDSEAPDDSSDDSEAPDDSSDDSEAPDDSSDDSEAPDDSSDDSEASDDSSDDSEASDDSSDDSEAPDDKSDDSDVPEDKSDDSDVPDDNSDDLEVPVPAEDLCNEGQIASDEEELVEAAAAVSQHDSSDDAGEQDLGENLSKPPSDPEANPEVSERKLPTEEEPAPVVEQSGKRKSKTKTIVEPPRKRQTKTKNIVEPPRKRQTKTKNIVEPLRKRKAKTKNVSVTPGHKKRGPSKKKPGAAKVEKRKTRTPKCKVPGCFLQDLEKSKKYSGKNLKRNKDELVQRIYDLFNRSVCDKKLPEKLRIGWNNKMVKTAGLCSTGEMWYPKWRRFAKIQIGLKVCDSADRIRDTLIHEMCHAASWLIDGIHDSHGDAWKYYARKSNRIHPELPRVTRCHNYKINYKVHYECTGCKTRIGCYTKSLDTSRFICAKCKGSLVMVPLTQKDGTRIVPHV

SEQ ID NO: 2569 - protein, 101 aa, Homo sapiens
MSDQEAKPSTEDLGDKKEGEYIKLKVIGQDSSEIHFKVKMTTHLKKLKESYCQRQGVPMNSLRFLFEGQRIADNHTPKELGMEEEDVIEVYQEQTGGHSTV

SEQ ID NO: 2570 - protein, 93 aa, Homo sapiens
MSGLRVYSTSVTGSREIKSQQSEVTRILDGKRIQYQLVDISQDNALRDEMRALAGNPKATPPQIVNGDQYCGDYELFVEAVEQNTLQEFLKLA

SEQ ID NO: 2571 - protein, 666 aa, Homo sapiens
MTPPPPGRAAPSAPRARVPGPPARLGLPLRLRLLLLLWAAAASAQGHLRSGPRIFAVWKGHVGQDRVDFGQTEPHTVLFHEPGSSSVWVGGRGKVYLFDFPEGKNASVRTVNIGSTKGSCLDKRDCENYITLLERRSEGLLACGTNARHPSCWNLVNGTVVPLGEMRGYAPFSPDENSLVLFEGDEVYSTIRKQEYNGKIPRFRRIRGESELYTSDTVMQNPQFIKATIVHQDQAYDDKIYYFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 2572 - protein, 162 aa, Homo sapiens
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 2573 - protein, 1050 aa, Homo sapiens
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVPRLIQKLNQQTILQVSCGNWHCLALAADGQFFTWGKNSHGQLGLGKEFPSQASPQRVRSLEGIPLAQVAAGGAHSFALSLSGAVFGWGMNNAGQLGLSDEKDRESPCHVKLLRTQKVVYISCGEEHTAVLTKSGGVFTFGAGSCGQLGHDSMNDEVNPRRVLELMGSEVTQIACGRQHTLAFVPSSGLIYAFGCGARGQLGTGHTCNVKCPSPVKGYWAAHSGQLSARADRFKYHIVKQIFSGGDQTFVLCSKYENYSPAVDFRTMNQAHYTSLINDETIAVWRQKLSEHNNANTINGVVQILSSAACWNGSFLEKKIDEHFKTSPKIPGIDLNSTRVLFEKLMNSQHSMILEQILNSFESCLIPQLSSSPPDVEAMRIYLILPEFPLLQDSKYYITLTIPLAMAILRLDTNPSKVLDNWWSQVCPKYFMKLVNLYKGAVLYLLRGRKTFLIPVLFNNYITAALKLLEKLYKVNLKVKHVEYDTFYIPEISNLVDIQEDYLMWFLHQAGMKARPSIIQDTVTLCSYPFIFDAQAKTKMLQTDAELQMQVAVNGANLQNVFMLLTLEPLLARSPFLVLHVRRNNLVGDALRELSIHSDIDLKKPLKVIFDGEEAVDAGGVTKEFFLLLLKELLNPIYGMFTYYQDSNLLWFSDTCFVEHNWFHLIGITCGLAIYNSTVVDLHFPLALYKKLLNVKPGLEDLKELSPTEGRSLQELLDYPGEDVEETFCLNFTICRESYGVIEQKKLIPGGDNVTVCKDNRQEFVDAYVNYVFQISVHEWYTAFSSGFLKVCGGKVLELFQPSELRAMMVGNSNYNWEELEETAIYKGDYSATHPTVKLFWETFHEFPLEKKKKFLLFLTGSDRIPIYGMASLQIVIQSTASGEEYLPVAHTCYNLLDLPKYSSKEILSARLTQALDNYEGFSLA

SEQ ID NO: 2574 - protein, 369 aa, Homo sapiens
MRACISLVLAVLCGLAWAEDHKESEPLPQLEEETEEALASNLYSAPTSCQGRCYEAFDKHHQCHCNARCQEFGNCCKDFESLCSDHEVSHSSDAITKEEIQSISEKIYRADTNKAQKEDIVLNSQNCISPSETRNQVDRCPKPLFTYVNEKLFSKPTYAAFINLLNNYQRATGHGEHFSAQELAEQDAFLREIMKTAVMKELYSFLHHQNRYGSEQEFVDDLKNMWFGLYSRGNEEGDSSGFEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 2575 - protein, 90 aa, Homo sapiens
MDPLRAQQLAAELEVEMMADMYNRMTSACHRKCVPPHYKEAELSKGESVCLDRCVSKYLDIHERMGKKLTELSMQDEELMKRVQQSSGPA

SEQ ID NO: 2576 - protein, 426 aa, Homo sapiens
MANDSGGPGGPSPSERDRQYCELCGKMENLLRCSRCRSSFYCCKEHQRQDWKKHKLVCQGSEGALGHGVGPHQHSGPAPPAAVPPPRAGAREPRKAAARRDNASGDAAKGKVKAKPPADPAAAASPCRAAAGGQGSAVAAEAEPGKEEPPARSSLFQEKANLYPPSNTPGDALSPGGGLRPNGQTKPLPALKLALEYIVPCMNKHGICVVDDFLGKETGQQIGDEVRALHDTGKFTDGQLVSQKSDSSKDIRGDKITWIEGKEPGCETIGLLMSSMDDLIRHCNGKLGSYKINGRTKAMVACYPGNGTGYVRHVDNPNGDGRCVTCIYYLNKDWDAKVSGGILRIFPEGKAQFADIEPKFDRLLFFWSDRRNPHEVQPAYATRYAITVWYFDADERARAKVKYLTGEKGVRVELNKPSDSVGKDVF

SEQ ID NO: 2577 - protein, 346 aa, Homo sapiens
MESVSCSAAAVRTGDMESQRDLSLVPERLQRREQERQLEVERRKQKRQNQEVEKENSHFFVATFARERAAVEELLERAESVERLEEAASRLQGLQKLINDSVFFLAAYDLRQGQEALARLQAALAERRRGLQPKKRFAFKTRGKDAASSTKVDAAPGIPPAVESIQDSPLPKKAEGDLGPSWVCGFSNLESQVLEKRASELHQRDVLLTELSNCTVRLYGNPNTLRLTKAHSCKLLCGPVSTSVFLEDCSDCVLAVACQQLRIHSTKDTRIFLQVTSRAIVEDCSGIQFAPYTWSYPEIDKDFESSGLDRSKNNWNDVDDFNWLARDMASPNWSILPEEERNIQWD

SEQ ID NO: 2578 - protein, 247 aa, Homo sapiens
MEFPKMLTRKIKLWDINAHITCRLCSGYLIDATTVTECLHTFCRSCLVKYLEENNTCPTCRIVIHQSHPLQYIGHDRTMQDIVYKLVPGLQEAEMRKQREFYHKLGMEVPGDIKGETCSAKQHLDSHRNGETKADDSSNKEAAEEKPEEDNDYHRSDEQVSICLECNSSKLRGLKRKWIRCSAQATVLHLKKFIAKKLNLSSFNELDILCNEEILGKDHTLKFVVVTRWRFKKAPLLLHYRPKMDLL

SEQ ID NO: 2579 - protein, 360 aa, Homo sapiens
MASATAPAAAVPTLASPLEQLRHLAEELRLLLPRVRVGEAQETTEEFNREMFWRRLNEAAVTVSREATTLTIVFSQLPLPSPQETQKFCEQVHAAIKAFIAVYYLLPKDQGITLRKLVRGATLDIVDGMAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQMADIVDISDEISPSVDDLALSIYPPMCHLTVRINSAKLVSVLKKALEITKASHVTPQPEDSWIPLLINAIDHCMNRIKELTQSELEL

SEQ ID NO: 2580 - protein, 412 aa, Homo sapiens
MAENLKGCSVCCKSSWNQLQDLCRLAKLSCPALGISKRNLYDFEVEYLCDYKKIREQEYYLVKWRGYPDSESTWEPRQNLKCVRILKQFHKDLERELLRRHHRSKTPRHLDPSLANYLVQKAKQRRALRRWEQELNAKRSHLGRITVENEVDLDGPPRAFVYINEYRVGEGITLNQVAVGCECQDCLWAPTGGCCPGASLHKFAYNDQGQVRLRAGLPIYECNSRCRCGYDCPNRVVQKGIRYDLCIFRTDDGRGWGVRTLEKIRKNSFVMEYVGEIITSEEAERRGQIYDRQGATYLFDLDYVEDVYTVDAAYYGNISHFVNHSCDPNLQVYNVFIDNLDERLPRIAFFATRTIRAGEELTFDYNMQVDPVDMESTRMDSNFGLAGLPGSPKKRVRIECKCGTESCRKYLF

SEQ ID NO: 2581 - protein, 110 aa, Homo sapiens
MVYERAGEAVPPRGLREKFPRALFGWAGERPSALCASNPPQLSCSGRGARYFRLGEVLGTDVGSSVGDFSGFWPFQTLVIVFSVQSSFGVWGFPSSCARHREAWPEGPVS

SEQ ID NO: 2582 - protein, 471 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYGDAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 2583 - protein, 392 aa, Homo sapiens
MGSLSTANVEFCLDVFKELNSNNIGDNIFFSSLSLLYALSMVLLGARGETAEQLEKVLHFSHTVDSLKPGFKDSPKCSQAGRIHSEFGVEFSQINQPDSNCTLSIANRLYGTKTMAFHQQYLSCSEKWYQARLQTVDFEQSTEETRKMINAWVENKTNGKVANLFGKSTIDPSSVMVLVNTIYFKGQRQNKFQVRETVKSPFQLSEGKNVTVEMMYQIGTFKLAFVKEPQMQVLELPYVNNKLSMIILLPVGIANLKQIEKQLNSGTFHEWTSSSNMMEREVEVHLPRFKLEIKYELNSLLKPLGVTDLFNQVKADLSGMSPTKGLYLSKAIHKSYLDVSEEGTEAAAATGDSIAVKSLPMRAQFKANHPFLFFIRHTHTNTILFCGKLASP

SEQ ID NO: 2584 - protein, 811 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKFLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 2585 - protein, 482 aa, Homo sapiens
MAEAATPGTTATTSGAGAAAATAAAASPTPIPTVTAPSLGAGGGGGGSDGSGGGWTKQVTCRYFMHGVCKEGDNCRYSHDLSDSPYSVVCKYFQRGYCIYGDRCRYEHSKPLKQEEATATELTTKSSLAASSSLSSIVGPLVEMNTGEAESRNSNFATVGAGSEDWVNAIEFVPGQPYCGRTAPSCTEAPLQGSVTKEESEKEQTAVETKKQLCPYAAVGECRYGENCVYLHGDSCDMCGLQLLHPMDAAQRSQHIKSCIEAHEKDMELSFAVQRSKDMVCGICMEVVYEKANPSERRFGILSNCNHTYCLKCIRKWRSAKQFESKIIKSCPECRITSNFVIPSEYWVEEKEEKQKLILKYKEAMSNKACRYFDEGRGSCPFGGNCFYKHAYPDGRREEPQRQKVGTSSRYRAQRRNHFWELIEERENSNPFDNDEEEVVTFELGEMLLMLLAAGGDDELTDSEDEWDLFHDELEDFYDLDL

SEQ ID NO: 2586 - protein, 146 aa, Homo sapiens [sequence omitted]

SEQ ID NO: 2587 - protein, 1674 aa, Homo sapiens
MEDASESSRGVAPLINNVVLPGSPLSLPVSVTGCKSHRVANKKVEARSEKLLPTALPPSEPKVDQKLPRSSERRGSGGGTQFPARSRAVAAGEAAARGAAGPERGSPLGRRVSPRCLCSGEGGQVAVGVIAGKRGRRGRDGSRRAPGGREMPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCTILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQEGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMFTEDEDDPGSHKRGRRGKRGQNGFKEFTRQEQINCVTRELLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRCRRLSFRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFRVIATKSSEQSRSVNIASKLSLQESESKRRCRKRQSPEPSPVTLGRRSSGRQGGVHELSAFEQLVVELVRHDDSWPFLKLVSKIQVPDYYDIIKKPIALNIIREKVNKCEYKLASEFIDDIELMFSNCFEYNPRNTSEAKAGTRLQAFFHIQAQKLGLHVTPSNVDQVSTPPAAKKSRI

SEQ ID NO: 2588 - protein, 103 aa, Homo sapiens
MAQFVRNLVEKTPALVNAAVTYSKPRLATFWYYAKVELVPPTPAEIPRAIQSLKKIANSAQTGSFKQLTVKEAVLNGLVATEVLMWFYVGEIIGKRGIIGYDV

SEQ ID NO: 2589 - protein, 156 aa, Homo sapiens
MSGGLLKALRSDSYVELSQYRDQHFRGDNEEQEKLLKKSCTLYVGNLSFYTTEEQIYELFSKSGDIKKIIMGLDKMKKTACGFCFVEYYSRADAENAMRYINGTRLDDRIIRTDWDAGFKEGRQYGRGRSGGQVRDEYRQDYDAGRGGYGKLAQNQ

SEQ ID NO: 2590 - protein, 436 aa, Homo sapiens
MDSVAFEDVAVNFTQEEWALLSPSQKNLYRDVTLETFRNLASVGIQWKDQDIENLYQNLGIKLRSLVERLCGRKEGNEHRETFSQIPDCHLNKKSQTGVKPCKCSVCGKVFLRHSFLDRHMRAHAGHKRSECGGEWRETPRKQKQHGKASISPSSGARRTVTPTRKRPYECKVCGKAFNSPNLFQIHQRTHTGKRSYKCREIVRAFTVSSFFRKHGKMHTGEKRYECKYCGKPIDYPSLFQIHVRTHTGEKPYKCKQCGKAFISAGYLRTHEIRSHALEKSHQCQECGKKLSCSSSLHRHERTHSGGKLYECQKCAKVFRCPTSLQAHERAHTGERPYECNKCGKTFNYPSCFRRHKKTHSGEKPYECTRCGKAFGWCSSLRRHEMTHTGEKPFDCKQCGKVFTFSNYLRLHERTHLAGRSQCFGRRQGDHLSPGV

SEQ ID NO: 2591 - protein, 92 aa, Homo sapiens
MQVSTAALAVLLCTMALCNQFSASLAADTPTACCFSYTSRQIPQNFIADYFETSSQCSKPGVIFLTKRSRQVCADPSEEWVQKYVSDLELSA

SEQ ID NO: 2592 - protein, 271 aa, Homo sapiens
MEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 2593 - protein, 659 aa, Homo sapiens
MAAVILESIFLKRSQQKKKTSPLNFKKRLFLLTVHKLSYYEYDFERGRRGSKKGSIDVEKITCVETVVPEKNPPPERQIPRRGEESSEMEQISIIERFPYPFQVVYDEGPLYVFSPTEELRKRWIHQLKNVIRYNSDLVQKYHPCFWIDGQYLCCSQTAKNAMGCQILENRNGSLKPGSSHRKTKKPLPPTPEEDQILKKPLPPEPAAAPVSTSELKKVVALYDYMPMNANDLQLRKGDEYFILEESNLPWWRARDKNGQEGYIPSNYVTEAEDSIEMYEWYSKHMTRSQAEQLLKQEGKEGGFIVRDSSKAGKYTVSVFAKSTGDPQGVIRHYVVCSTPQSQYYLAEKHLFSTIPELINYHQHNSAGLISRLKYPVSQQNKNAPSTAGLGYGSWEIDPKDLTFLKELGTGQFGVVKYGKWRGQYDVAIKMIKEGSMSEDEFIEEAKVMMNLSHEKLVQLYGVCTKQRPIFIITEYMANGCLLNYLREMRHRFQTQQLLEMCKDVCEAMEYLESKQFLHRDLAARNCLVNDQGVVKVSDFGLSRYVLDDEYTSSVGSKFPVRWSPPEVLMYSKFSSKSDIWAFGVLMWEIYSLGKMPYERFTNSETAEHIAQGLRLYRPHLASEKVYTIMYSCWHEKADERPTFKILLSNILDVMDEES

SEQ ID NO: 2594 - protein, 417 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 2595 - protein, 468 aa, Homo sapiens
MAPPPARVHLGAFLAVTPNPGSAASGTEAAAATPSKVWGSSAGRIEPRGGGRGALPTSMGQHGPSARARAGRAPGPRPAREASPRLRVHKTFKFVVVGVLLQVVPSSAATIKLHDQSIGTQQWEHSPLGELCPPGSHRSEHPGACNRCTEGVGYTNASNNLFACLPCTACKSDEEERSPCTTTRNTACQCKPGTFRNDNSAEMCRKCSRGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLE

SEQ ID NO: 2596 - protein, 185 aa, Homo sapiens
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 2597 - protein, 851 aa, Homo sapiens
MSSKQEIMSDQRFRRVAKDPRFWEMPEKDRKVKIDKRFRAMFHDKKFKLNYAVDKRGRPISHSTTEDLKRFYDLSDSDSNLSGEDSKALSQKKIKKKKTQTKKEIDSKNLVEKKKETKKANHKGSENKTDLDNSIGIKKMKTSCKFKIDSNISPKKDSKEFTQKNKKEKKNIVQHTTDSSLEEKQRTLDSGTSEIVKSPRIECSKTRREMQSVVQLIMTRDSDGYENSTDGEMCDKDALEEDSESVSEIGSDEESENEITSVGRASGDDDGSEDDEEEDEDEEEDEDEDSEDDDKSDSGPDLARGKGNIETSSEDEDDTADLFPEESGFEHAWRELDKDAPRADEITRRLAVCNMDWDRLKAKDLLALFNSFKPKGGVIFSVKIYPSEFGKERMKEEQVQGPVELLSIPEDAPEKDWTSREKLRDYQFKRLKYYYAVVDCDSPETASKIYEDCDGLEFESSCSFIDLRFIPDDITFDDEPKDVASEVNLTAYKPKYFTSAAMGTSTVEITWDETDHERITMLNRKFKKEELLDMDFQAYLASSSEDEEEIEEELQGDDGVNVEEDGKTKKSQKDDEEQIAKYRQLLQVIQEKEKKGKENDMEMEIKWVPGLKESAEEMVKNKLEGKDKLTPWEQFLEKKKEKKRLKRKQKALAEEASEEELPSDVDLNDPYFAEEVKQIGINKKSVKSAKDGTSPEEEIEIERQKAEMALLMMDEDEDSKKHFNYNKIVEHQNLSKKKKKQLMKKKELIEDDFEVNVNDARFQAMYTSHLFNLDPSDPNFKKTKAMEKILEEKARQRERKEQELTQAIKKKESEIEKESQRKSIDPALSMLIKSIKTKTEQFQARKKQKVK

SEQ ID NO: 2598 - protein, 244 aa, Homo sapiens
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSLGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETPPPFPG

SEQ ID NO: 2599 - protein, 395 aa, Homo sapiens
MPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 2600 - protein, 282 aa, Homo sapiens
MSLLATLGLELDRALLPASGLGWLVDYGKLPPAPAPLAPYEVLGGALEGGLPVGGEPLAGDGFSDWMTERVDFTALLPLEPPLPPGTLPQPSPTPPDLEAMASLLKKELEQMEDFFLDAPPLPPPSPPPLPPPPLPPAPSLPLSLPSFDLPQPPVLDTLDLLAIYCRNEAGQEEVGMPPLPPPQQPPPPSPPQPSRLAPYPHPATTRGDRKQKKRDQNKSAALRYRQRKRAEGEALEGECQGLEARNRELKERAESVEREIQYVKDLLIEVYKARSQRTRSC

SEQ ID NO: 2601 - protein, 23 aa, Homo sapiens
METSEGPGLESTGSYLGIQQRSP

SEQ ID NO: 2602 - protein, 491 aa, Homo sapiens
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2603 - protein, 950 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 2604 - protein, 313 aa, Homo sapiens
MSQSRHRAEAPPLEREDSGTFSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 2605 - protein, 198 aa, Homo sapiens
MSNVRVSNGSPSLERMDARQAEHPKPSACRNLFGPVDHEELTRDLEKHCRDMEEASQRKWNFDFQNHKPLEGKYEWQEVEKGSLPEFYYRPPRPPKGACKVPAQESQDVSGSRPAAPLIGAPANSEDTHLVDPKTDPSDSQTGLAEQCAGIRKRPATDDSSTQNKRANRTEENVSDGSPNAGSVEQTPKKPGLRRRQT

SEQ ID NO: 2606 - protein, 727 aa, Homo sapiens [sequence omitted]

SEQ ID NO: 2607 - protein, 537 aa, Homo sapiens
MAWRGAGPSVPGAPGGVGLSLGLLLQLLLLLGPARGFGDEEERRCDPIRISMCQNLGYNVTKMPNLVGHELQTDAELQLTTFTPLIQYGCSSQLQFFLCSVYVPMCTEKINIPIGPCGGMCLSVKRRCEPVLKEFGFAWPESLNCSKFPPQNDHNHMCMEGPGDEEVPLPHKTPIQPGEECHSVGTNSDQYIWVKRSLNCVLKCGYDAGLYSRSAKEFTDIWMAVWASLCFISTAFTVLTFLIDSSRFSYPERPIIFLSMCYNIYSIAYIVRLTVGRERISCDFEEAAEPVLIQEGLKNTGCAIIFLLMYFFGMASSIWWVILTLTWFLAAGLKWGHEAIEMHSSYFHIAAWAIPAVKTIVILIMRLVDADELTGLCYVGNQNLDALTGFVVAPLFTYLVIGTLFIAAGLVALFKIRSNLQKDGTKTDKLERLMVKIGVFSVLYTVPATCVIACYFYEISNWALFRYSADDSNMAVEMLKIFMSLLVGITSGMWIWSAKTLHTWQKCSNRLVNSGKVKREKRGNGWVKPGKGSETVV

SEQ ID NO: 2608 - protein, 362 aa, Homo sapiens
MLVMAPRTVLLLLSAALALTETWAGSHSMRYFYTSVSRPGRGEPRFISVGYVDDTQFVRFDSDAASPREEPRAPWIEQEGPEYWDRNTQIYKAQAQTDRESLRNLRGYYNQSEAGSHTLQSMYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 2609 - protein, 350 aa, Homo sapiens
METNSSLPTNISGGTPAVSAGYLFLDIITYLVFAVTFVLGVLGNGLVIWVAGFRMTHTVTTISYLNLAVADFCFTSTLPFFMVRKAMGGHWPFGWFLCKFVFTIVDINLFGSVFLIALIALDRCVCVLHPVWTQNHRTVSLAKKVIIGPWVMALLLTLPVIIRVTTVPGKTGTVACTFNFSPWTNDPKERINVAVAMLTVRGIIRFIIGFSAPMSIVAVSYGLIATKIHKQGLIKSSRPLRVLSFVAAAFFLCWSPYQVVALIATVRIRELLQGMYKEIGIAVDVTSALAFFNSCLNPMLYVFMGQDFRERLIHALPASLERALTEDSTQTSDTATNSTLPSAEVELQAK

SEQ ID NO: 2610 - protein, 638 aa, Homo sapiens
MSASSSGGSPRFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 2611 - protein, 197 aa, Homo sapiens
MTLLPGLLFLTWLHTCLAHHDPSLRGHPHSHGTPHCYSAEELPLGQAPPHLLARGAKWGQALPVALVSSLEAASHRGRHERPSATTQCPVLRPEEVLEADTHQRSISPWRYRVDTDEDRYPQKLAFAECLCRGCIDARTGRETAALNSVRLLQSLLVLRRRPCSRDGSGLPTPGAFAFHTEFIHVPVGCTCVLPRSV

SEQ ID NO: 2612 - protein, 570 aa, Homo sapiens
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQGRNWDPAQLSRTTQGLTALLLSLKKCPMIRYQLSSEAAKRLAECVKQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKSFLEEVLASGLHSRSKESSQVTSRSASRR

SEQ ID NO: 2613 - protein, 474 aa, Homo sapiens
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 2614 - protein, 793 aa, Homo sapiens
MESRAEGGSPAVFDWFFEAACPASLQEDPPILRQFPPDFRDQEAMQMVPKFCFPFDVEREPPSPAVQHFTFALTDLAGNRRFGFCRLRAGTQSCLCILSHLPWFEVFYKLLNTVGDLLAQDQVTEAEELLQNLFQQSLSGPQASVGLELGSGVTVSSGQGIPPPTRGNSKPLSCFVAPDSGRLPSIPENRNLTELVVAVTDENIVGLFAALLAERRVLLTASKLSTLTSCVHASCALLYPMRWEHVLIPTLPPHLLDYCCAPMPYLIGVHASLAERVREKALEDVVVLNVDANTLETTFNDVQALPPDVVSLLRLRLRKVALAPGEGVSRLFLKAQALLFGGYRDALVCSPGQPVTFSEEVFLAQKPGAPLQAFHRRAVHLQLFKQFIEARLEKLNKGEGFSDQFEQEITGCGASPGALRSYQLWADNLKKGGGALLHSVKAKTQPAVKNMYRSAKSGLKGVQSLLMYKDGDSVLQRGGSLRAPALPSRSDRLQQRLPITQHFGKNRPLRPSRRRQLEEGTSEPPGAGTPPLSPEDEGCPWAEEALDSSFLGSGEELDLLSEILDSLSMGAKSAGSLRPSQSLDCCHRGDLDSCFSLPNILRWQPDDKKLPEPEPQPLSLPSLQNASSLDATSSSKDSRSQLIPSESDQEVTSPSQSSTASADPSIWGDPKPSPLTEPLILHLTPSHKAAEDFTAQENPTPWLSTAPTEPSPPESPQILAPTKPNFDIAWTSQPLDPSSDPSSLEDPRARPPKALLAERAHLQPREEPGALNSPATPTSNCQKSQPSKPAQSR

SEQ ID NO: 2615 - protein, 83 aa, Homo sapiens
MSFFQLLMKRKELIPLVVFMTVAAGGASSFAVYSLWKTDVILDRKKNPEPWETVDPTVPQKLITINQQWKPIEELQNVQRVTK

SEQ ID NO: 2616 - protein, 2413 aa, Homo sapiens
MGISTVILEMCLLWGQVLSTGGWIPRTTDYASLIPSEVPLDQTVAEGSPFPSESTLESTAAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWAMSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWAMSAPGNARFGQGSGPIVLDDVRCSGHESYLWSCPHNGWLSHNCGHHEDAGVICSVSQSRPTPSPDTWPTSHASTAGSESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQPGCGWAMSAPGNARFGQGSGPIVLDDVRCSGHESYPWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 2617 - protein, 143 aa, Homo sapiens [sequence omitted]

SEQ ID NO: 2618 - protein, 272 aa, Homo sapiens
MEEEAIASLPGEETEDMDFLSGLELADLLDPRQPDWHLDPGLSSPGPLSSSGGGSDSGGLWRGDDDDEAAAAEMQRFSDLLQRLLNGIGGCSSSSDSGSAEKRRRKSPGGGGGGGSGNDNNQAATKSPRKAAAAAARLNRLKKKEYVMGLESRVRGLAAENQELRAENRELGKRVQALQEESRYLRAVLANETGLARLLSRLSGVGLRLTTSLFRDSPAGDHDYALPVGKQKQDLLEEDDSAGGVCLHVDKDKVSVEFCSACARKASSSLKM

SEQ ID NO: 2619 - protein, 694 aa, Homo sapiens
MKHLKRWWSAGGGLLHLTLLLSLAGLRVDLDLYLLLPPPTLLQDELLFLGGPASSAYALSPFSASGGWGRAGHLHPKGRELDPAAPPEGQLLREVRALGVPFVPRTSVDAWLVHSVAAGSADEAHGLLGAAAASSTGGAGASVDGGSQAVQGGGGDPRAARSGPLDAGEEEKAPAEPTAQVPDAGGCASEENGVLREKHEAVDHSSQHEENEERVSAQKENSLQQNDDDENKIAEKPDWEAEKTTESRNERHLNGTDTSFSLEDLFQLLSSQPENSLEGISLGDIPLPGSISDGMNSSAHYHVNFSQAISQDVNLHEAILLCPNNTFRRDPTARTSQSQEPFLQLNSHTTNPEQTLPGTNLTGFLSPVDNHMRNLTSQDLLYDLDINIFDEINLMSLATEDNFDPIDVSQLFDEPDSDSGLSLDSSHNNTSVIKSNSSHSVCDEGAIGYCTDHESSSHHDLEGAVGGYYPEPSKLCHLDQSDSDFHGDLTFQHVFHNHTYHLQPTAPESTSEPFPWPGKSQKIRSRYLEDTDRNLSRDEQRAKALHIPFSVDEIVGMPVDSFNSMLSRYYLTDLQVSLIRDIRRRGKNKVAAQNCRKRKLDIILNLEDDVCNLQAKKETLKREQAQCNKAINIMKQKLHDLYHDIFSRLRDDQGRPVNPNHYALQCTHDGSILIVPKELVASGHKKETQKGKRK

SEQ ID NO: 2620 - protein, 391 aa, Homo sapiens
MKCLVTGGNVKVLGKAVHSLSRIGDELYLEPLEDGLSLRTVNSSRSAYACFLFAPLFFQQYQAATPGQDLLRCKILMKSFLSVFRSLAMLEKTVEKCCISLNGRSSRLVVQLHCKFGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 2621 - protein, 1429 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 2622 - protein, 179 aa, Homo sapiens
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 2623 - protein, 261 aa, Homo sapiens
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENGKTVIRVLKQKEVEQLIKKHEEEEAKAEREKKEKEQKEKDK

SEQ ID NO: 2624 - protein, 377 aa, Homo sapiens
MKFPGPLENQRLSFLLEKAITREAQMWKVNVRKMPSNQNVSPSQRDEVIQWLAKLKYQFNLYPETFALASSLLDRFLATVKAHPKYLSCIAISCFFLAAKTVEEDERIPVLKVLARDSFCGCSSSEILRMERIILDKLNWDLHTATPLDFLHIFHAIAVSTRPQLLFSLPKLSPSQHLAVLTKQLLHCMACNQLLQFRGSMLALAMVSLEMEKLIPDWLSLTIELLQKAQMDSSQLIHCRELVAHHLSTLQSSLPLNSVYVYRPLKHTLVTCDKGVFRLHPSSVPGPDFSKDNSKPEVPVRGTAAFYHHLPAASGCKQTSTKRKVEEMEVDDFYDGIKRLYNEDNVSENVGSVCGTDLSRQEGHASPCPPLQPVSVM

SEQ ID NO: 2625 - protein, 575 aa, Homo sapiens
MLGVLVLGALALAGLGFPAPAEPQPGGSQCVEHDCFALYPGPATFLNASQICDGLRGHLMTVRSSVAADVISLLLNGDGGVGRRRLWIGLQLPPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALARHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 2626 - protein, 332 aa, Homo sapiens
MAAVFLVTLYEYSPLFYIAVVFTCFIVTTGLVLGWFGWDVPVILRNSEETQFSTRVFKKQMRQVKNPFGLEITNPSSASITTGITLTTDCLEDSLLTCYWGCSVQKLYEALQKHVYCFRISTPQALEDALYSEYLYQEQYFIKKDSKEEIYCQLPRDTKIEDFGTVPRSRYPLVALLTLADEDDREIYDIISMVSVIHIPDRTYKLSCRILYQYLLLAQGQFHDLKQLFMSANNNFTPSNNSSSEEKNTDRSLLEKVGLSESEVEPSEENSKDCVVCQNGTVNWVLLPCRHTCLCDGCVKYFQQCPMCRQFVQESFALCSQKEQDKDKPKTL

SEQ ID NO: 2627 - DNA, 50 bp, Homo sapiens
agagcacttgcagagcctgggacaacctccttattgaagggaagagggac

SEQ ID NO: 2628 - DNA, 50 bp, Homo sapiens
taaggagtgttggagatatgtgatttggctagtgctatttaaagacaccc

SEQ ID NO: 2629 - DNA, 50 bp, Homo sapiens
gccaagacaataagctaggctactgggtccagctactactttggtgggat

SEQ ID NO: 2630 - DNA, 50 bp, Homo sapiens
gtaaaggctatacttgtcttgttcaccttgggatgacgccgcatgatatg

SEQ ID NO: 2631 - DNA, 50 bp, Homo sapiens
tgtcagagattgcctgtggctctaatatgcacctcaagattttaaggaga

SEQ ID NO: 2632 - DNA, 50 bp, Homo sapiens
ctttgcctaaaccctatggcctcctgtgcatctgtactcaccctgtacca

SEQ ID NO: 2633 - DNA, 50 bp, Homo sapiens
accttgggttgagtaatgctcgtctgtgtgttttagtttcatcacctgtt

SEQ ID NO: 2634 - DNA, 70 bp, Homo sapiens
atttatattagtttagccaaaggataagtgtcctatggggatggtccactgtcactgtttctctgctgtt

SEQ ID NO: 2635 - DNA, 50 bp, Homo sapiens
cccatgtaagcaccccttcatttggcattccccacttgagaattaccctt

SEQ ID NO: 2636 - DNA, 50 bp, Homo sapiens
tggaccgtaatgaatgaatgtacacgccataaacgccctttgttcaagca

SEQ ID NO: 2637 - DNA, 50 bp, Homo sapiens
tttcaagacagaaagtgacgcagagaacctccccggcccagtctcgacgc

SEQ ID NO: 2638 - DNA, 50 bp, Homo sapiens
tgcactaaacagttgccccaaaagacatatcttgttttaaggcccagacc

SEQ ID NO: 2639 - DNA, 50 bp, Homo sapiens
gggtaggcagcttgcacccagttctcctttatctcaacttattttcctgg

SEQ ID NO: 2640 - DNA, 50 bp, Homo sapiens
ttaatgccagtcctcatgtaacctcaggtatcttcagcttgtggagaata

SEQ ID NO: 2641 - DNA, 50 bp, Homo sapiens
tgattttgcaacttaggatgtttttgagtcccatggttcattttgattgt

SEQ ID NO: 2642 - DNA, 50 bp, Homo sapiens
tttgagcgatctctcacatgatggggttctttagtacatggtaacagcca

SEQ ID NO: 2643 - DNA, 50 bp, Homo sapiens
tgtttcgtaaattaaataggtctggcccagaagacccactcaattgcctt

SEQ ID NO: 2644 - DNA, 50 bp, Homo sapiens
accttgtaagtgcctaagaaatgagactacaagctccatttcagcaggac

SEQ ID NO: 2645 - DNA, 50 bp, Homo sapiens
acagggcctcagcaagggagccatacatttttgtaacattttgatatgtt

SEQ ID NO: 2646 - DNA, 50 bp, Homo sapiens
acaaccaaccagtttcttttctagccaatcatctctgaagagttgctgtt

SEQ ID NO: 2647 - DNA, 50 bp, Homo sapiens
cacacctgcacactcacggctgaaatctccctaacccagggggaccttag

SEQ ID NO: 2648 - DNA, 50 bp, Homo sapiens
catcctcaggtggtcaggcgtagatcaccagaataaacccagcttccctc

SEQ ID NO: 2649 - DNA, 50 bp, Homo sapiens
gggagtgttgtgactgaaatgcttgaaaccaaagcttcagataaacttgc

SEQ ID NO: 2650 - DNA, 50 bp, Homo sapiens
ctctcctcagactgctcaagagaagcacatgaaaaccattacctgacttt

SEQ ID NO: 2651 - DNA, 50 bp, Homo sapiens
atccagccccacccaatggccttttgtgcttgtttcctataacttcagta

SEQ ID NO: 2652 - DNA, 50 bp, Homo sapiens
tttacaagaattgtccatgtgcttccctaggctgagctggcattggtctg

SEQ ID NO: 2653 - DNA, 50 bp, Homo sapiens
catggagacttgaggagggcttgaggttggtgaggttaggtgcgtgtttc

SEQ ID NO: 2654 - DNA, 50 bp, Homo sapiens
tgtctgttttaatcatgtatctggaatagggtcgggaagggtttgtgcta

SEQ ID NO: 2655 - DNA, 50 bp, Homo sapiens
acaagtttacatgataaaaagaaatgtgatttgtcttcccttctttgcac

SEQ ID NO: 2656 - DNA, 50 bp, Homo sapiens
aaaaatacacatcacacccatttaaaagtgatcttgagaaccttttcaaa

SEQ ID NO: 2657 - DNA, 50 bp, Homo sapiens
tgtgtgttgatcccaagacaatgaaagtttgcactgtatgctggacggca

SEQ ID NO: 2658 - DNA, 50 bp, Homo sapiens
acctagcggacaatgatggagagatctatgatgatattgctgatggctgc

SEQ ID NO: 2659 - DNA, 50 bp, Homo sapiens
gcaatccacaatctgacattctcaggaagcccccaagttgatatttctat

SEQ ID NO: 2660 - DNA, 50 bp, Homo sapiens
gcctccaaccatgttcccttcttcttagcaccacaaataatcaaaaccca

SEQ ID NO: 2661 - DNA, 50 bp, Homo sapiens
ggcagagaaggaggagtatgagcatcagaagagggagctggagcaaatct

SEQ ID NO: 2662 - DNA, 50 bp, Homo sapiens
tggaaatgtcatctaaccattaagtcatgtgtgaacacataaggacgtgt

SEQ ID NO: 2663 - DNA, 50 bp, Homo sapiens
tgccattaagcaggaatgtcatgttccagttcattacaaaagaaaacaat

SEQ ID NO: 2664 - DNA, 50 bp, Homo sapiens
cctctcaggacgtgccgggtttatcattgctttgttatttgtaaggactg

SEQ ID NO: 2665 - DNA, 50 bp, Homo sapiens
cgaagaagagccacagtgagggagatcccatccccttgtctgaactggag

SEQ ID NO: 2666 - DNA, 50 bp, Homo sapiens
ttgatgatgtaacttgaccttccagagttatggaaattttgtccccatgt

SEQ ID NO: 2667 - DNA, 50 bp, Homo sapiens
ctggacaactttgagtactgacatcattgataaataaactggcttgtggt

SEQ ID NO: 2668 - DNA, 50 bp, Homo sapiens
aggtttcatcaggtggttaaagtcgtcaaagttgtaagtgactaaccaag

SEQ ID NO: 2669 - DNA, 50 bp, Homo sapiens
acctgttatcctttgtagagcacacagagttaaaagttgaatatagcaat

SEQ ID NO: 2670 - DNA, 50 bp, Homo sapiens
gggcggcccggagccagccaggcagttttattgaaatctttttaaataat

SEQ ID NO: 2671 - DNA, 50 bp, Homo sapiens
tccctaatagaaagccacctattctttgttggatttcttcaagtttttct

SEQ ID NO: 2672 - DNA, 50 bp, Homo sapiens
tgccttttgagcaaatagggaatctaagggaggaaattatcaactgtgca

SEQ ID NO: 2673 - DNA, 50 bp, Homo sapiens
gagcacccagagggatttttcagtgggaagcattacactttgctaaatca

SEQ ID NO: 2674 - DNA, 50 bp, Homo sapiens
acagctcaagtaccctaatttagttcttttggactaatacaattcaggaa

SEQ ID NO: 2675 - DNA, 50 bp, Homo sapiens
ttcctgcctggattatttaaaaagccatgtgtggaaacccactatttaat

SEQ ID NO: 2676 - DNA, 50 bp, Homo sapiens
gcagaaaaggggaactcatttagctcacgagtggtcgagtgaagattgaa

SEQ ID NO: 2677 - DNA, 50 bp, Homo sapiens
acagcaaagccccaactaatctttagaagcatattggaactgataactcc

SEQ ID NO: 2678 - DNA, 50 bp, Homo sapiens
atcctgagctgcacttacctgtgagagtcttcaaacttttaaaccttgcc

SEQ ID NO: 2679 - DNA, 50 bp, Homo sapiens; identical to SEQ ID NO: 2645

SEQ ID NO: 2680 - DNA, 50 bp, Homo sapiens
acgacccattttgcaagacttaaagccggaagaacacattttcagattgt

SEQ ID NO: 2681 - DNA, 50 bp, Homo sapiens
aactgaacacaattttgggacaacgtttaaacattacttttcatacttga

SEQ ID NO: 2682 - DNA, 50 bp, Homo sapiens
cacgcttagggcagggatctgggaaattccagtgatctcctttagcagag

SEQ ID NO: 2683 - DNA, 50 bp, Homo sapiens
agcatgtgtctgccatttcatttgtacgcttgttcaaaaccaagtttgtt

SEQ ID NO: 2684 - DNA, 50 bp, Homo sapiens
cttgtatctctaaatatggtgtgatatgaaccagtccattcacattggaa

SEQ ID NO: 2685 - DNA, 50 bp, Homo sapiens
cagaggtgggagtaactgctggtagtgccttctttggttgtgttgctcag

SEQ ID NO: 2686 - DNA, 50 bp, Homo sapiens
tccagggaccaacattaacacaaccaatcaacacatcatgttacagaact

SEQ ID NO: 2687 - DNA, 50 bp, Homo sapiens
tgtgggttgagaccagcactctgtgaaaccttgaaatgagaagtaaaggc

SEQ ID NO: 2688 - DNA, 50 bp, Homo sapiens; identical to SEQ ID NO: 2632

SEQ ID NO: 2689 - DNA, 50 bp, Homo sapiens
aaatacaaacattctaattaaaggctttgcaacacatgccttgtctgttt

SEQ ID NO: 2690 - DNA, 50 bp, Homo sapiens; identical to SEQ ID NO: 62

SEQ ID NO: 2691 - DNA, 50 bp, Homo sapiens
ctcatctaaagacaccttcctttccactggctgtcaagccacagggcacc

SEQ ID NO: 2692 - DNA, 50 bp, Homo sapiens
gagttaccacaccccatgagggaagctctaaatagccaacacccatctgt

SEQ ID NO: 2693 - DNA, 50 bp, Homo sapiens
cccacactgctttgctgtgtatacgcttgttgccctgaaataaatatgca

SEQ ID NO: 2694 - DNA, 50 bp, Homo sapiens
cctgaaacagctgccaccatcactcgcaagagaatcccctccatctttgg

SEQ ID NO: 2695 - DNA, 50 bp, Homo sapiens
ggaagaaccgtccagagctgagtgacgctgggatccgggatcaaagttgg

SEQ ID NO: 2696 - DNA, 50 bp, Homo sapiens
atttccagtgagcttatcatgctgtctttacatggggttttcaattttgc

SEQ ID NO: 2697 - DNA, 50 bp, Homo sapiens
tgcaagacatagaatagtgttggaaaatgtgcaatatgtgatgtggcaaa

SEQ ID NO: 2698 - DNA, 50 bp, Homo sapiens
agtactcatgacttgagagacgtggacggagccagcttctaccttgcttg

SEQ ID NO: 2699 - DNA, 50 bp, Homo sapiens
ccttccaaagcggtcacctgatagggaagtcttacggctaggaagttaca

SEQ ID NO: 2700 - DNA, 50 bp, Homo sapiens
tgttataaaagaggattttcccaccttgacaccaggcaatgtagttagca

SEQ ID NO: 2701 - DNA, 50 bp, Homo sapiens
aataagggtgttgccctttgttccctcacataatcgtgaaaggctgcttt

SEQ ID NO: 2702 - DNA, 50 bp, Homo sapiens
cggattccaaattacttaaagcctttatgggaacacggtagattgtaggt

SEQ ID NO: 2703 - DNA, 50 bp, Homo sapiens
acacttgatctcttccttatttctctcagaaaacctgtaggattgtgcct

SEQ ID NO: 2704 - DNA, 50 bp, Homo sapiens
cccgaggaggaagacgaatcgttaaacatctgaaagggtcaggtgagtat

SEQ ID NO: 2705 - DNA, 50 bp, Homo sapiens
gctagcacgactctgccttgttcctttggagacaattgttatcatcaata

SEQ ID NO: 2706 - DNA, 50 bp, Homo sapiens
ccctcaaatctcccaatctactccagggaaaagacacttcaagtgagaga

SEQ ID NO: 2707 - DNA, 50 bp, Homo sapiens
ggaccaaaggctgattcttggagatttaactccccacaggcaatgggttt

SEQ ID NO: 2708 - DNA, 50 bp, Homo sapiens
gcctcccgtgcatctgtactcaccctgtacgacaaacacattacattatt

SEQ ID NO: 2709 - DNA, 50 bp, Homo sapiens
cagactattccccacctgcttcccagcttcacaataaacggctgcgtctc

SEQ ID NO: 2710 - DNA, 50 bp, Homo sapiens
aactcttggcctcagaggaaggaaaagcaactcaacactcatggtcaagt

SEQ ID NO: 2711 - DNA, 50 bp, Homo sapiens
tgggaaagtgtgagttaatattggacacattttatcctgatccacagtgg

SEQ ID NO: 2712 - DNA, 50 bp, Homo sapiens
ttaaaaggagcacattaaaattctcagaggacttggcaagggccgcacag

SEQ ID NO: 2713 - DNA, 50 bp, Homo sapiens
gcacacgccatctgtgtaacttcaggatctgttctgtttcaccatgtaac

SEQ ID NO: 2714 - DNA, 50 bp, Homo sapiens
ttggagcgtttttgtgtttgagatattagctcaggtcaattccaaagagt

SEQ ID NO: 2715 - DNA, 50 bp, Homo sapiens
aggaaaccaagccctcacaggaaagaaagcctgattcaagaaaacaaagt

SEQ ID NO: 2716 - DNA, 50 bp, Homo sapiens; identical to SEQ ID NO: 2644

SEQ ID NO: 2717 - DNA, 50 bp, Homo sapiens
gcctcagtacagagggggctctggaagtgtttgttgactgaataaacgga

SEQ ID NO: 2718 - DNA, 50 bp, Homo sapiens
ggttaacgcttctgtgaggaccttctggctcttgagataccctaaatatt

SEQ ID NO: 2719 - DNA, 50 bp, Homo sapiens
aggcaaaagtcatttcttccctatattttgtcatgcttatctcctgtctc

SEQ ID NO: 2720 - DNA, 50 bp, Homo sapiens
gagaaagctcccagtctgtctttcccaacatcccttcagtttcaataagc

SEQ ID NO: 2721 - DNA, 50 bp, Homo sapiens
ggaggttaggaagcccttttaaagtacaaacccccggcatggggaatttt

SEQ ID NO: 2722 - DNA, 50 bp, Homo sapiens
gaaaggataatttcgaacccttgcatagtttcggtatgggccgtgccaac

SEQ ID NO: 2723 - DNA, 50 bp, Homo sapiens
cagacctgtgggctgattccagactgagagttgaagttttgtgtgcatca

SEQ ID NO: 2724 - DNA, 50 bp, Homo sapiens
aaatctcatttgcaagttctcccattaagcaagggagtagtttactagga

SEQ ID NO: 2725 - DNA, 50 bp, Homo sapiens
caaacaccggcagttgaaaggaaaaggacggggaatgtgatggaaaagag

SEQ ID NO: 2726 - DNA, 50 bp, Homo sapiens
tggataaatctgagcaactttcttctttgtgctccaggaacctacgcact

SEQ ID NO: 2727 - DNA, 50 bp, Homo sapiens
gacattcatctgtttccactgagtctgagtcttcaagttttcactccagc

SEQ ID NO: 2728 - DNA, 50 bp, Homo sapiens
cagtggttcctgagagaatcttagttcaaaggactgcccccgccaacccc

SEQ ID NO: 2729 - DNA, 51 bp, Homo sapiens
taggctatagagatgtgagggattattattagtcacacctctagtcatgcc

SEQ ID NO: 2730 - DNA, 50 bp, Homo sapiens
actctttgtctttttaagacccctaatagccctttgtaacttgatggctt

SEQ ID NO: 2731 - DNA, 50 bp, Homo sapiens
acctccaagaacatctgcctttgttgaacgtgtttattacctgtccactc

SEQ ID NO: 2732 - DNA, 50 bp, Homo sapiens
ttgtgctcctgatacgacgttgccacagttaatccgttctgatctctgct

SEQ ID NO: 2733 - DNA, 50 bp, Homo sapiens
acccttggtcactggtgtttcaaacattctggcaagtcacatcaatcaag

SEQ ID NO: 2734 - DNA, 50 bp, Homo sapiens; identical to SEQ ID NO: 2643

SEQ ID NO: 2735 - DNA, 50 bp, Homo sapiens
ttgtaaggttccggggaactgactcaacatggttctccaactcgaggttg

SEQ ID NO: 2736 - DNA, 50 bp, Homo sapiens
tggtccactgtcactgtttctctgctgttgcaaatacatggataacacat

SEQ ID NO: 2737 - DNA, 50 bp, Homo sapiens
ggaacttctgcttccacttacgatgaaggaacttgtactcaatccatcca

SEQ ID NO: 2738 - DNA, 50 bp, Homo sapiens
tgctcagggcacatgcacacagacatttatctctgcactcacattttgtg

SEQ ID NO: 2739 - DNA, 50 bp, Homo sapiens
tgtcctctgaacctgagtgaagaaatatactctgtcctttgtacctgcgt

SEQ ID NO: 2740 - DNA, 50 bp, Homo sapiens
tgcactctaccagatttgaacatctagtgaggttcacattcatactaagt

SEQ ID NO: 2741 - DNA, 50 bp, Homo sapiens
gggtgtgatgaatagcgaatcatctcaaatccttgagcactcagtctagt

SEQ ID NO: 2742 - DNA, 50 bp, Homo sapiens
tgctgaaagtggtcccaaaggggtactagtttttaagctcccaactcccc

SEQ ID NO: 2743 - DNA, 50 bp, Homo sapiens; identical to SEQ ID NO: 2643

SEQ ID NO: 2744 - DNA, 50 bp, Homo sapiens
agaatggcagacctgtttgctgaagtgttcataagataacaataggcttg

SEQ ID NO: 2745 - DNA, 50 bp, Homo sapiens
ggcccagtgctaatgtaaccaatgatgccatgtcgatattggaaaccata

SEQ ID NO: 2746 - DNA, 50 bp, Homo sapiens
tcttgtcctagtcattgtggcaaccccatctgacaccttgtgtagtacct

SEQ ID NO: 2747 - DNA, 50 bp, Homo sapiens
aagagtaagaggcaacagatagagtgtccttggtaataagaagtcagaga

SEQ ID NO: 2748 - DNA, 50 bp, Homo sapiens
tttccaatgctccttgctccattttaaacttgctgtcctttataagagaa

SEQ ID NO: 2749 - DNA, 50 bp, Homo sapiens
acattcatctgtttccactgaggtctgagtcttcaagttttcaccccagc

SEQ ID NO: 2750 - DNA, 50 bp, Homo sapiens
tgtgtgcgacagggaggaagtttcaataaagcaacaacaagcttcaagga

SEQ ID NO: 2751 - DNA, 50 bp, Homo sapiens
ctccaccacctgaccagagtgttctcttcagaggactggctcctttccca

SEQ ID NO: 2752 - DNA, 50 bp, Homo sapiens
ccccaaccacaggcatcaggcaaccatttgaaataaaactccttcagcct

SEQ ID NO: 2753 - DNA, 50 bp, Homo sapiens
cgctcaaaggtcactgagacttttgcctcacctaaagagaccaaggctca

SEQ ID NO: 2754 - DNA, 50 bp, Homo sapiens
ccctttgtgagaagaagcaggtttcctttcctatggattgatgtgaccct

SEQ ID NO: 2755 - DNA, 50 bp, Homo sapiens
agaaggacccctggttgagaaccacggttgtatagaaaggaattgaagca

SEQ ID NO: 2756 - DNA, 50 bp, Homo sapiens
aggtgccagcaactgaataaatacctctcccagtgtaaatctggagccaa

SEQ ID NO: 2757 - DNA, 50 bp, Homo sapiens
gaaggaagaagtggggtggaagaagtggggtgggacgacagtgaaatcta

SEQ ID NO: 2758 - DNA, 50 bp, Homo sapiens
tgaaatatgggaaagttgctgctattgattcagggtctgtcttggaggca

SEQ ID NO: 2759 - DNA, 50 bp, Homo sapiens
tgattacaaaaggcgtattctttcatggtttctgcaatgagaggaagtgt

SEQ ID NO: 2760 - DNA, 50 bp, Homo sapiens
aggagctatgattagacttctgttagacttcctcactctatcacccacat

SEQ ID NO: 2761 - DNA, 50 bp, Homo sapiens
agttgttagttgccctgctacctagtttgttagtgcatttgagcacacat

SEQ ID NO: 2762 - DNA, 50 bp, Homo sapiens
aagtggaagtgggtgaattctactttttatgttggagtggaccaatgtct

SEQ ID NO: 2763 - DNA, 50 bp, Homo sapiens
catttgtaccctaggcccacgaacccacgagaatgtcctctgacttccag

SEQ ID NO: 2764 - DNA, 50 bp, Homo sapiens
gcactgaatatcgaacaagcactcaaattgaagtatcagtcatgttttgt

SEQ ID NO: 2765 - DNA, 50 bp, Homo sapiens
tctacctgcagtctccattgtttccagagtgaacttgtaattatcttgtt

SEQ ID NO: 2766 - DNA, 50 bp, Homo sapiens
ggccagcctggacccaatcatgaggaagatgcagactcttatgagaacat

SEQ ID NO: 2767 - DNA, 50 bp, Homo sapiens
tgggattcattggcccataggtacattggaaaatgtatatctctccagct

SEQ ID NO: 2768 - DNA, 50 bp, Homo sapiens
accgtgtaaagtggggatggggtaaaagtggttaacgtactgttggatca

SEQ ID NO: 2769 - DNA, 50 bp, Homo sapiens
tggcaaattctgcgagtgtgataatttcaactgtgatagatccaatggct

SEQ ID NO: 2770 - DNA, 50 bp, Homo sapiens
cctagggtgaaacacgtgacagaagaataaagactattgaatagtcctct

SEQ ID NO: 2771 - DNA, 50 bp, Homo sapiens
tgagcctttcacacctgtgctggcgctggaaaattatttgtgctcagctg

SEQ ID NO: 2772 - DNA, 50 bp, Homo sapiens
tgctattgccttcctattttgcataataaatgcttcagtgaaaatgcagc

SEQ ID NO: 2773 - DNA, 50 bp, Homo sapiens
gtgtaacacagtgccttcaataaatggtatagcaaatgttttgacatgaa

SEQ ID NO: 2774 - DNA, 50 bp, Homo sapiens
tgccaagcacagtgcctgcatgtatttatccaataaatgtgaaattctgt

SEQ ID NO: 2775 - DNA, 50 bp, Homo sapiens
acattgtaatagaaacagatttcccaaattccagcctggcatgaggtaat

SEQ ID NO: 2776 - DNA, 50 bp, Homo sapiens
tcactatctttctgataacagaattgccaaggcagcgggatctcgtatct

SEQ ID NO: 2777 - DNA, 50 bp, Homo sapiens
tctcaaaggagtaactgcagcttggtttgaaatttgtactgtttctatca

SEQ ID NO: 2778 - DNA, 50 bp, Homo sapiens
gacaggatcccccagagaccccatttgcctctcaacactcagaccttcaa

SEQ ID NO: 2779 - DNA, 50 bp, Homo sapiens
agtgccttccctgcctgtgggggtcatgctgccacttttaatgggtcctc

SEQ ID NO: 2780 - DNA, 50 bp, Homo sapiens
attccattctattgtttacacaacgattactcgaagatgactgcaaaggt

SEQ ID NO: 2781 - DNA, 50 bp, Homo sapiens
actgagagtggtgtctggatatattccttttgtcttcatcactttctgaa

SEQ ID NO: 2782 - DNA, 50 bp, Homo sapiens
gaagctgctaggggaaggactggcctggctccagaatgttgttgcctttt

SEQ ID NO: 2783 - DNA, 50 bp, Homo sapiens
agccctgcaaaaattcagagtccttgcaaaattgtctaaaatgtcagtgt

SEQ ID NO: 2784 - DNA, 50 bp, Homo sapiens
gggcagagaaggtggagagtaaagacccaacattactaacaatgatacag

SEQ ID NO: 2785 - DNA, 50 bp, Homo sapiens
aatatatgcaattctccctcccccagcccttccctgacccctaagttatt

SEQ ID NO: 2786 - DNA, 50 bp, Homo sapiens
agggagactctcagccttcagcttcctaaattctgtgtctgtgactttcg

SEQ ID NO: 2787 - DNA, 50 bp, Homo sapiens
atgctggtgtcatgtgacatttgttgagtctcgggcatgttcacggtggg

SEQ ID NO: 2788 - DNA, 51 bp, Homo sapiens
caccgcctctgcctccgcctcttccactggagagcccgaggtcaaaaggtc

SEQ ID NO: 2789 - DNA, 50 bp, Homo sapiens
atttggacagatgcagaaggaactgttagtgagtcaagacaaacacatct

SEQ ID NO: 2790 - DNA, 50 bp, Homo sapiens
acattttcctccgcataagcctgcgtcagattaaaacactgaactgacaa

SEQ ID NO: 2791 - DNA, 50 bp, Homo sapiens
tccagccagccagctcatttcactttacaccctcatggactgggattata

SEQ ID NO: 2792 - DNA, 50 bp, Homo sapiens
ctggtctgtgtcgttggctttatgacaggaagtgcctgtgggttatctta

SEQ ID NO: 2793 - DNA, 50 bp, Homo sapiens
accaaaaagggctacattaccaccactgtatcataaaagccagccacctt

SEQ ID NO: 2794 - DNA, 50 bp, Homo sapiens
gattcttgtctggctaataaatcatcaccaactgccttctcctacaggga

SEQ ID NO: 2795 - DNA, 50 bp, Homo sapiens
ccccagacgaaaataccaaatgcatggagagctcccgtgagtggttaata

SEQ ID NO: 2796 - DNA, 1549 bp, Homo sapiens
cttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtgcttgtggctgtgccgtatgtcttctctggttcgttctgttttatgatgaccccaaagaccacccatgtataagcatcagtgaaaaggaatacatcacatcctccctggtccagcaggtcagttcaagtagacaatctctgcctatcaaggctatacttaagtcgcttccagtctgggctatttccattggtagttttacgtttttctggtcacataacatcatgacactatacactccaatgtttatcaactccatgcttcatgttaatataaaagagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctgaagtgtgaaacagagcacttgcagagcctgggacaacctccttattgaagggaagagggaccagcacatgaggctgaggctgaggggcagtcaccagcaccaggaagaaggtggtaggaggagtcctaggggct

SEQ ID NO: 2797 - DNA, 626 bp, Homo sapiens
tttttttttccatttctatgagtttaatacagtaccagggttcagacatttccatgaaatattaactctaaacaaacataacagcattctagcagtagtcttcagctaacatgctaatgggattaagttgctagaaccctctgttagtatgtggacacaagacagattggcatacctggtttaggcatcactccaaacaaagtttgtaatccaggattactagattcctaaaccctatttatgcaaggacaggggtgtctttaaatagcactagccaaatcacatatctccaacactccttaattttccagtgcaaaataacttcttttatttattaggctaattagggaaccttctagaactctctagagataaagatcattaaggccttatagtagtccttcaaacactaccaaccacttcctaaaagatgtgtgtccagttaaagtattttaaattttagctacaaccttatagaggattaagaatacacacacacgcacacacacacacacctgtctatactagaatatttaaaagtaagttatagacaatataatagctagataaaacaaaagaataaggtatatgggttttataaagacacacagtataatgatggtgtc

SEQ ID NO: 2798 - DNA, 5601 bp, Homo sapiens
atggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgcgtgtgcatgcagctggaggtgcctctggacctggaggtgcttctgctaagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggtggaagatggtgctgacgtgagcatctcggacctcttcaacaccagggttaacaagggcccgagggtgaccgtgcttttggggaaggctggcatgggcaagaccacgctggcccaccggctctgccagaagtgggcagagggccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggagcggaccatcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagcgacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggcttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgaagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttga

SEQ ID NO: 2799 - DNA, 5133 bp, Homo sapiens
cctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttggcctgtgaccctgggctgtctcgaacgtgtgaccagaacacctatctgagtggcctgtgttacctcttccgccagaatctgcagggtcccatgctgcaggggcgccctggttttcaggaatgtatcaagggcaacgtagacctggtatttctgtttgatggttcgatgagcttgcagccagatgaatttcagaaaattctggacttcatgaaggatgtgatgaagaaactcagcaacacttcgtaccagtttgctgctgttcagttttccacaagctacaaaacagaatttgatttctcagattatgttaaatggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctctacccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgcagggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgaatgtctcctttgcaggctcatagggaagacctgctgagggaccagccaagagggctgcaaaagtgagggcttgtcattaccagacggttcaccagcctctcttggttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgcccacccctccttccttgaccagcagatcccagctcacgtcacacacttggttgggtcctcacatctttcacacttccaccaccctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgacgccgcatgatatgtcagggcgtgggacatctagtaggtgcttgacataatttcactgaattaatgacagagccagtgggaagatacagaaaaagagggccggggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccggacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaa

SEQ ID NO: 2800 - DNA, 2376 bp, Homo sapiens
cgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtgg

SEQ ID NO: 2801 - DNA, 1158 bp, Homo sapiens
gcctgctgctctggcccctggtcctgtcctcttctccagcatggtgtgtctgaagctccctggaggctccagcttggcagcgttgacagtgacactgatggtgctgagctcccgactggctttcgctggggacacccgaccacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcacagtgcagcggcgagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacttgccaagtggagcacccaagcgtaacgagcgctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgcagatgacaatttaaggaagaatcttctgccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagtt

SEQ ID NO: 2802 - DNA, 3597 bp, Homo sapiens
ggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctc

SEQ ID NO: 2803 - DNA, 696 bp, Homo sapiens; identical to SEQ ID NO: 436

SEQ ID NO: 2804 - DNA, 1451 bp, Homo sapiens
gaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatc

SEQ ID NO: 2805 - DNA, 1439 bp, Homo sapiens
taattctctcacattcccatggaaggtaaagccatcgcgacgtctctcggtggtgatcgtgtattgatattcccgtgttctcctcgctcttccttcgtttttacatcccggctctctagcctgcctctaaagcgtgcgtctatcggtggtgctgtctcttgttccggcgtcaatggcttgactcggtggaattccattgtttcgactcgccgactcgttcctgttcgttcaattaactcggaatcggactcggactccgacttccctcacgagaatcagcagggaaatccaggtttggggaaatttaaggaataccaagaatgggactcatggacggccaagttctccggtggagcaaacattccgtttctcatgctccaattgcctcagatcatcctcaatacccagaatcttttggcgggaaacaataccgctctttcggctgtcccatggctgggaatgttgactggtttgttaggaaacctttcgttgctttcttattttgctaagaagagagaaaaagaagcagctgtggtgcaaacactgggagtggtctctactcacattgtgcttgcacagctcacaatggctgaagcaatgcctattcagtattttgttgctacttcagctgttgtcaccatcggtctcattgtgaactgtttgtactatttcggtaagcttagcaaaactgtgtggcaactgtgggaagacgttatcactattggtggactctccgttcttcctcaaatcatgtggtcaacatttgtccctcttgtaccaaacagtatcttgcctgggacaactgcttttggtattgctgtggcagctataatcatggctcgaactgggaaactttcagagaaaggtgttaggtttgtagggtctttatctggatggacagcaactcttatgttcatgtggatgccagtttcccaaatgtggacaaattttctaaacccggacaacataaaaggcttatcgtcaatcacaatgttgctctcgatgatgggaaacgggcttatgatccctcgagcactatttatccgtgatttgatgtggctcactggttcgctatgggcaactctcttttatggatatggaaatattctttgcttatacctggtaaattgcaccagccagtcattcttcgtggcagctacaattggtttgatctcatggataggactggctttgtggagagatgcagtggcttatggtcacaactcgccgtttagatctttgaaagaacttgtttttggaccgtaatgaatgaatgtacacgccataaacgccctttgttcaagcaagtccatagagattacatgtattttcattcttttttcctaagggttataagacaactactctgtaatttcatgtatttttttacttgaatcatatagtaaaataatgtctgatatcaaaaaaaaaaaaaaaaa

SEQ ID NO: 2806 - DNA, 954 bp, Homo sapiens
ggcacgaggcggttgcacacttttttaaaaaaagtaaatggatttgccacaattaaatgtcataacatttatgacagaatataaaatattaacatattttaagccaagttttaggtgtattttttgaatcttggttataaacccaattttaaagggcgatgtatccagcgttgtgaaggcaacagagtgtacccatatttatatttttataaaatacctataagactgtgaatctcttgtgctaatggctgagttaattgaaggatcgttttgcccctttttagcctcccagagcttcgaggactcaattcgaacccgaaatcctgccgtgggggaggggttgcgtcgagacctgggcccggggaggttctcctgcgtcactttctgtcctgaaaggcgcccttcctggtttctgtggctccaattttctatgcagccccacaccccttgttgttttgatcctgagaaataaaagggaggctgaattattcaaattaaaatgaggtttccccttcatggaagtgctgctgacccttcgtgcagaaatggggagcacttgaggacacaggtgggtggaggccctttgtgcgtggctggtcgtattcgggcagccctccgtcgctttttataaaactttgtgtgagaagaatatattgataatgtcagtgaaacaagcagacattgaaatggaggcacagattactccacaaggagttcttctgtatattttttctagatgcaaatacctttttaattatgttaattaatgttaagactttctaggcttatatcgaagctgtgtgtgggtcacggggtgatcactgctaactggataaagtttgtgcagcacattcctgagtgtacgatattgacctgtagcccagcgtgaaaaatttataaataaatttttcattgatctttttatattaaaaaaaaaaaaaaaaaaaaaagttg

SEQ ID NO: 2807 - DNA, 459 bp, Homo sapiens
atggaggctgaagctgctgttcggaggccctctattggtgcctctctcctgccgtcatcactatggcaggaaaacagagatggtttagtaatgaattatcattcccaaacccgtgtccacctggaacatcaggatgggaccatgtttgaaaatcgggtctttccaaatgtaattaagtaaggcgaggccatactgcatttacaatgggcccaatccagtgtccctatgagagacggaagaggagacacagacacaaagcaggaggccacataaagacagaggcagagactgaagtgatgctgccccaagcccaggggatgcctggagtccccaggagctgggagaggcaggaagggaccctcccctagagtctcttggagggaactgatacaattgcagagtgcactaaacagttgccccaaaagacatatcttgttttaaggcccagacctgaaattt

SEQ ID NO: 2808 - DNA, 553 bp, Homo sapiens
acaacatggtctccacatggctggctggctggctgtccctgtgtgtgtgtgacacacggtgtgagtgcagggctgtgcgtgtgtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattgtcctggggagaggtgctagaggga

SEQ ID NO: 2809 - DNA, 4628 bp, Homo sapiens
gagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagcatgctatactgaactcaacaagatcttggctgtacataaatatttgtaaaagagaccctttgcacctttttactgtcatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaat

SEQ ID NO: 2810 - DNA, 1245 bp, Homo sapiens
ggcacgaggcaggcgctgacgaggagcccggctgagggaggatgcgccgctgacgcctgcgggagccgcgcgcctggggcgggaggatgctccagaggggcctctggccgtggcgcacgcggctgctgccgacccctggcacctggcgcccagcgcgcccgtggccgctgccgcctccgccccaggttttgcgtgtgaagctgtgtggaaatgtgaaatactaccagtcacaccattatagtaccgtggtgccacctgatgaaataacagttatttatagacatggccttcccttggtaacacttaccttgccatctagaaaagaacgttgtcaattcgtagtcaaaccaatgttgtcaacagttggttcattccttcaggacctacaaaatgaagataagggtatcaaaactgcagccatcttcacagcagatggcaacatgatttcagcttctaccttgatggatattttgctaatgaatgattttaaacttgtcattaataaaatagcatatgatgtgcagtgtccaaagagagaaaaaccaagtaatgagcacactgctgagatggaacacatgaaatccttggttcacagactatttacaatcttgcatttagaagagtctcagaaaaagagagagcaccatttactggagaaaattgaccacctgaaggaacagctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggtcttttttgcatactttatagtcactcgacaggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaaaaaaaaaaaaaaaaaaaaaaaaaa

SEQ ID NO: 2811 - DNA, 3780 bp, Homo sapiens
tactggacaaacatttcctccaaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggcagctgtcgccattttcttcgtcatcaccttcctcatcttcccgtgctctagttgtgacagggaaaagaagccgcgacagcatagtggggaccatgagaacctgatgaacgtgccttcagacaaggagatgttcagccgttcagttactagcctggcaacagatgctcctgccagcagtgagcagaatggggcactcaccaatggggacattctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaggagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaagagatttagctcattgtcatacaagtctcgggaagaagaccccactctcacagaagaagagatctcagctatgtactcatcagtaaataaacctggacagttagtgaataaatcggggcagtcgcttacagttccggagtccacctacacctccattcaaggggacccacagaggtcaccctcctcctgtaatgatctctatgctactgttaaagacttcgaaaaaactccaaacagcacacttccaccagcagggaggcccagcgaggagccagagcctgattatgaagcgatacagactctcaacagagaggaagaaaaggccaccctggggaccaatggccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccagctgtcagtggtctcatctcattagtgaggaaagccaagctgtatggaaaagctgcactcaccaaggaccacaatgcccccggcctaaagtactgccattcagaaaagcaggtttttcttcctctctttccttttctctgtctgctactgactttaaggctttttcccccttgaaatgtccagattcctgtggttcatcccaaggaaattttcacacaaagcttggcctttgccctcaatataggtgttttaggatggtgacaaaccatggctgctgctttctgcccagctcgccagtcctccccaaagagttgcgcatcagcacctggggatctggaccctgcgggtgaagggatggggagggacgtccctggagtctcttctgtctttgttccttcttattttggcattcgatatcagcagcctctccccaaagtacttgaagtcagttttagatgctttattttatttttctagtcaaaaacgtgtttcccccagtgtttgaaaactcgtccgaatcttttcagtattttccatgagtattgtggtacttctagacttgtttaagcccagaactcattccttcaaaacagagagccttaatctttatgttgggacacagaccacatatttggacggcagccatgcatccatcgctgaagggctgtggacatgaatgtgtatttcccatggtctccgctgcccacaccaacagtgtggcatctcataagttaactgctaccctaaggtaatctaagattaaaatgtaaacatttatttttgttatgtaagtttataagatgttttatgttcaatgcctaatttctcaaaagtgccagaaaaaaatgtatattagctattttgattttatgtacaatgatttatactctccttttgaaaagataccataaagcacataagctagatcactacaaggagctgttatcttttttctaatcaagtgtttaaaacactgatggtttttaaagactcacctttttaaatggtacttggagctcctgattcaaattacctagaccccctagagaaataaatggaatatacataaataatcattttcagtggtttatggtgggcaatattgcaatatttgaaatggtaaaaatggaaagaagaacaaaatatgatgagaggtggctgtgaattataaacctcataaaagtgtcataattccattaaggtttaattatattttttcagaaaacagtgatgaattctgtagtccagtgcttgccaatgcaaattgcctattggaatcttcttcctatattttacaaacatcagtggctgaaatagctcagagtaagagctcagcctggtttgaatttaatcatctctttagatcttataaggccagcattaggaaacttgttcacttttcattttcaaaggagcctagttgaagtgctattatgagtgtgggctatggaaagacagcttttcctacactgataaagaaaaaaaatgaggaaattatttcatccccttgtgacatctgtgactttttggatttaataatcttgctgtttttcctctttatgacaaagaatataattgggaggatgaagtgtcttaaaaattgtagagaccagctcactggaatgtttttccatccctgtattcatggcttgactttgtgactgctctacactgcatgtctgacattgcagagtgagctatgttgaggtaaactggttggttgtcattattttgcaatcagcctggtctctcccatgaagatgtcgtgtgcataagcacaatcatcactgattagaagatcacagcagaatacccttggattagagagaagttcgtaccttgcatttctctgaattctagtctctcataagcactgctttgctggatgattttcactgctttgtgttaatgactttgagcgatctctcacatgatggggttctttagtacatggtaacagccatgtcatcttacacacctagcattgtgaatgctgtagtgacatcctttataggcaccttacagctcaaaacttttgtttcatttcatgccttacttatcaaaaaggcaggaaagtaggtatgatctctaaagtaaaaaaaa

SEQ ID NO: 2812 - DNA, 2176 bp, Homo sapiens
aaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttattctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacgaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaa

SEQ ID NO: 2813 - DNA, 580 bp, Homo sapiens
  misc_feature (1)..(1): n is a, c, g, t or u
nccttttgcccatgttgtctggaatgcccttcttctccctcttgtttacatcaagcatcagactgaatatccctcttgtgcggccttctaaaacctcccgtccaaagcgaaatatattgccctctatttatacttttacagcatttggcacacaagtacagagtagtagctttttatcacattctctgataattatatagatatggtatttcttagctctctctccaactggctaataagttgctttttgtctgagtgcctaattttgtgttttgtgtctgagtgcctcagttcctcaaaaaaaggttttttgattagttcattattcatttgaacatggaaattatgctcactagtggcaaatgccactaaccgtattccagaagctaggtgtcatgtttgcaataagatatattatcccttctacaagtcaccttttatttcaggcatttgtaaatgcccattaataaagtatggttcataaattttaccttgtaagtgcctaagaaatgagactacaagctccatttcagcaggacacaataaatattattttataatgccgaaaaaaaaaaaaaaa

SEQ ID NO: 2814 - DNA, 5426 bp, Homo sapiens
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagag

SEQ ID NO: 2815 - DNA, 6050 bp, Homo sapiens
ggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaagagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccagctgtggaacaactattttcatctggcagtggcttttatcacccaggattctctgcagctggagcagttctcacacgccaaatacaacaaaatcctgaataagtatggggacatgagacggctaattggcttctccatccgtgatatgtggtacaagcttggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaagtttgaaaacgaaatcatcctgaagctggaccacgaggtagaagggggccgaggcgacgagcagtacatgcagctgctggagtcaatcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcactgtgaacctgctgaatttctacaaagataacaacagggaggagatgtacataaggtacctgtacaaactccgcgatcttcacctggactgtgacaattacacagaggctgcctacacgctccttctccacacctggcttctcaagtggtcggatgagcagtgtgcatcacaggtcatgcagacaggccagcagcacccccagacacaccggcagctcaaggagacgctctacgagaccatcataggctactttgacaaaggaaagatgtgggaagaggccataagtctgtgcaaggagctggcggaacagtacgagatggagatctttgactatgagctgctcagccagaacctgatccagcaggcaaaattctatgaaagcatcatgaaaatcctcaggcccaaaccagactactttgctgttggatactacggccagggattcccctccttcctgcggaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtatatccagtgcttcactgtccagcctgtcttggatgaacatcccaggttcaagaataagccagtgcctgaccagattataaacttctacaaatccaactacgtgcaaaggttccactactcccggcccgtgcgcagggggaccgtagacccagagaatgagtttgcttccatgtggattgagagaacctccttcgtgactgcatacaagctgccggggatcctgcgctggtttgaggtggtgcacatgtcgcagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcaagaacctgaaaatgaaggtggagaaggagtacggtgtccgagagatgcctgactttgacgacaggagagtgggccgccccaggtctatgctgcgctcatacagacagatgtccatcatctctctggcttccatgaattctgactgcagcacccccagcaagcctacctcagagagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcggctttccaggaagcatgagttcatgagtgacaccaacctctcggagcatgcggccatccccctcaaggcgtctgtcctctctcaaatgagctttgccagccagtccatgcctaccatcccagccctggcgctctcagtggcaggcatccctgggttggatgaggccaacacatctccccgcctcagccagaccttcctccaactctcagatggtgacaagaagacactcacacggaagaaggtcaatcagttcttcaagacaatgctggccagcaaatcggctgaagaaggcaaacagatcccagactcgctgtccacggacctgtgagctgctgctgactagggctgcatgggagagccagggaggggagtttctggaagaggaaagccatgcgtggaacatcgaagcctcagagagtgggagactgtccccatcagttgtccttacttagaggagacagagaggccaatcaggtcccagagctggagtgctaacaagcccagcatcccctggggctgtgatcatggtggatgaggaagcctcaacgtagattcctgaactcaaggtaccagcaagaatgccttctcccagtgtgctctccccaacatcctaggcacagctttcataacccagtttcttaggtgtaagaaactgcttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaataaaaaatgttctcttggttcg

SEQ ID NO: 2816 - DNA, 1030 bp, Homo sapiens
agatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttctcgacctgttcggctaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatg

SEQ ID NO: 2817 - DNA, 2454 bp, Homo sapiens
ggaataggttagtttcagacaagcctgcttgccggagctcagcagacaccaggccttccgggcaggcctggcccaccgtgggcctcagagctgctgctggggcattcagaaccggctctccattggcattgggaccagagaccccgcaagtggcctgtttgcctggacatccacctgtacgtccccaggtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgctgaggccgcggaaggagcagggcacatacgccctgtccctcatctatgggaagacggtgtaccactacctcatcagccaagacaaggcgggcaagtactgcattcccgagggcaccaagtttgacacgctctggcagctggtggagtatctgaagctgaaggcggacgggctcatctactgcctgaaggaggcctgccccaacagcagtgccagcaacgcctcaggggctgctgctcccacactcccagcccacccatccacgttgactcatcctcagagacgaatcgacaccctcaactcagatggatacacccctgagccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgcccgctcagcagggaagtggccgctcaagtggtacgcacccgaatgcatcaacttccgcaagttctccagccgcagcgatgtctggagctatggggtcaccatgtgggaggccttgtcctacggccagaagccctacaagaagatgaaagggccggaggtcatggccttcatcgagcagggcaagcggatggagtgcccaccagagtgtccacccgaactgtacgcactcatgagtgactgctggatctacaagtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttgaaaaaaaaaaaaaaaaaaaaacc

SEQ ID NO: 2818 - DNA, 2761 bp, Homo sapiens
agaggacgcccggtgaaggggctccagcctggcagtttctgcgtgttagcatttctagaatagagtgggtgggaactgacccaagtaaagtcccagagactcgaacactgacgcacaggaaagcctcaagtgggaggagaaatgcaaatcccctactgatgatggcgtcagcggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacag

SEQ ID NO: 2819 - DNA, 1190 bp, Homo sapiens
cagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccgaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatgaccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgggctcaatctgaatctgcccagagcaagatgctgagtggcattggaggcttcgtgctggggctgatcttcctcgggctgggccttatcatccatcacaggagtcagaaagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcctctgcctgtgcacggccagctgcatctactcaggccccaaggggtttctgtttctattctctcctcagactgctcaagagaagcacatgaaaaccattacctgactttagagcttttttacataattaaacatgatcctgagtt

SEQ ID NO: 2820 - DNA, 3003 bp, Homo sapiens
tcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgta

SEQ ID NO: 2821 - DNA, 718 bp, Homo sapiens
ttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtctt

SEQ ID NO: 2822 - DNA, 2776 bp, Homo sapiens
cagggcagactggtagcaaagcccccacgcccagccaggagcaccgccgcggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacggaaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttggccacagctcttgaggatgtcaccaattaaccagaaatccagttattttccgccctcaaaatgacagccatggccggccggtgcttctgggggctcgtcggggggacagctccactctgactggcacagtctttgcatggagacttgaggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaaataaaacttcaat

SEQ ID NO: 2823 - DNA, 4428 bp, Homo sapiens
aggtcacagagcagtgataactacctgccagtgtctcttaggagtgaggtacctggagttcggggaccccaacctgtgacaatgacagcagacaaattggttttctttgtgaatggcagaaaggtggtggagaaaaatgcagatccagagacaacccttttggcctacctgagaagaaagttggggctgagtggaaccaagctcggctgtggagaggggggctgcggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccctggcatcgtcatgagtatgtacacactgctccggaatcagcccgagcccaccatggaggagattgagaatgccttccaaggaaatctgtgccgctgcacaggctacagacccatcctccagggcttccggacctttgccagggatggtggatgctgtggaggagatgggaataatccaaattgctgcatgaaccagaagaaagaccactcagtcagccactcgccatctttattcaaaccagaggagttcacgcccctggatccaacccaggagcccatttttcccccagagttgctgaggctgaaagacactcctcggaagcagctgcgatttgaaagggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacactagtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagcttcacagttccttttctgaatcaggcaggagccctacttcatgtgtacacagatggctctgtgctgctgacccacggggggactgagatgggccaaggccttcataccaaaatggtccaggtggccagtagagctctgaaaatccccacctctaagatttatatcagcgagacaagcactaacactgtgcccaacacctctcccacggctgcctctgtcagcgctgacctcaatggacaggccgtctatgcggcttgtcagaccatcttgaaaaggctggaaccctacaagaagaagaatcccagtggctcctgggaagactgggtcacagctgcctacatggacacagtgagcttgtctgccactgggttttatagaacacccaatctgggctacagctttgagactaactcagggaaccgcttccactacttcagctatggggtggcttgctctgaagtagaaatcgactgcctaacaggagatcataagaacctccgcacagatattgtcatggatgttggctccagtctaaaccctgccattgatattggacaggtggaaggggcatttgtccagggccttggcctcttcaccctagaggagctacactattcccccgaggggagcctgcacacccgtggccctagcacctacaagatcccggcatttggcagcatccccattgagttcagggtgtccctgctccgcgactgccccaacaagaaggccatctatgcatcgaaggctgttggagagccgcccctcttcctggctgcttctatcttctttgccatcaaagatgccatccgtgcagctcgagctcagcacacaggtaataacgtgaaggaactcttccgcctagacagccctgccaccccggagaagatccgcaatgcctgcgtggacaagttcaccaccctgtgtgtcactggtgtcccagaaaactgcaaaccctggtctgtgagggtctaaagagagagtcctcagcagagtcttcttgtgctgcctttgggcttccatggagcaggaggaacataccacagaacatggatctattaaagtcacagaatgacagacctgtgatttgtcaagatgggatttggaagacaagtgaatgcaatggaagattttgatcaaaaatgtaatttgtaaacacaatgataagcaaattcaaaactgttatgcctaaatggtgaatatgcaattaggatcattttctgtctgttttaatcatgtatctggaatagggtcgggaagggtttgtgctattccccacttactggacagcctgtataacctcaaaaaaaaaaaaaaaaa

SEQ ID NO: 2824 - DNA, 1702 bp, Homo sapiens
aaattttccagccgatcactggagctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacat

SEQ ID NO: 2825 - DNA, 2771 bp, Homo sapiens
cgaggcggatcgggtgttgcatccatggagcgagctgagagctcgagtacagaacctgctaaggccatcaaacctattgatcggaagtcagtccatcagatttgctctgggcaggtggtactgagtctaagcactgcggtaaaggagttagtagaaaacagtctggatgctggtgccactaatattgatctaaagcttaaggactatggagtggatcttattgaagtttcagacaatggatgtggggtagaagaagaaaacttcgaaggcttaactctgaaacatcacacatctaagattcaagagtttgccgacctaactcaggttgaaacttttggctttcggggggaagctctgagctcactttgtgcactgagcgatgtcaccatttctacctgccacgcatcggcgaaggttggaactcgactgatgtttgatcacaatgggaaaattatccagaaaaccccctacccccgccccagagggaccacagtcagcgtgcagcagttattttccacactacctgtgcgccataaggaatttcaaaggaatattaagaaggagtatgccaaaatggtccaggtcttacatgcatactgtatcatttcagcaggcatccgtgtaagttgcaccaatcagcttggacaaggaaaacgacagcctgtggtatgcacaggtggaagccccagcataaaggaaaatatcggctctgtgtttgggcagaagcagttgcaaagcctcattccttttgttcagctgccccctagtgactccgtgtgtgaagagtacggtttgagctgttcggatgctctgcataatcttttttacatctcaggtttcatttcacaatgcacgcatggagttggaaggagttcaacagacagacagtttttctttatcaaccggcggccttgtgacccagcaaaggtctgcagactcgtgaatgaggtctaccacatgtataatcgacaccagtatccatttgttgttcttaacatttctgttgattcagaatgcgttgatatcaatgttactccagataaaaggcaaattttgctacaagaggaaaagcttttgttggcagttttaaagacctctttgataggaatgtttgatagtgatgtcaacaagctaaatgtcagtcagcagccactgctggatgttgaaggtaacttaataaaaatgcatgcagcggatttggaaaagcccatggtagaaaagcaggatcaatccccttcattaaggactggagaagaaaaaaaagacgtgtccatttccagactgcgagaggccttttctcttcgtcacacaacagagaacaagcctcacagcccaaagactccagaaccaagaaggagccctctaggacagaaaaggggtatgctgtcttctagcacttcaggtgccatctctgacaaaggcgtcctgagacctcagaaagaggcagtgagttccagtcacggacccagtgaccctacggacagagcggaggtggagaaggactcggggcacggcagcacttccgtggattctgaggggttcagcatcccagacacgggcagtcactgcagcagcgagtatgcggccagctccccaggggacaggggctcgcaggaacatgtggactctcaggagaaagcgcctgaaactgacgactctttttcagatgtggactgccattcaaaccaggaagataccggatgtaaatttcgagttttgcctcagccaactaatctcgcaaccccaaacacaaagcgttttaaaaaagaagaaattctttccagttctgacatttgtcaaaagttagtaaatactcaggacatgtcagcctctcaggttgatgtagctgtgaaaattaataagaaagttgtgcccctggacttttctatgagttctttagctaaacgaataaagcagttacatcatgaagcacagcaaagtgaaggggaacagaattacaggaagtttagggcaaagatttgtcctggagaaaatcaagcagccgaagatgaactaagaaaagagataagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggctttgattttgttatcgatgaaaatgctccagtcactgaaagggctaaactgatttccttgccaactagtaaaaactggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaaacctgctacttaaaaaaaatacacatcacacccatttaaaagtgatcttgagaaccttttcaaacc

SEQ ID NO: 2826 - DNA, 3682 bp, Homo sapiens
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttgtggaaagcctctgctgccatggcgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttaaaaaaaa

SEQ ID NO: 2827 - DNA, 2400 bp, Homo sapiens
taggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcctaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggtttccctgctcctcctaaacaattggacatgggagatgaagtttacgatgatgtggatacctctgatttccctgtttcatcagcagagatgagtcaaggaactaattttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcatt

SEQ ID NO: 2828 - DNA, 2015 bp, Homo sapiens
cggaggcacggaagatgaggaagatgatcaggaggatgatgaaggtgaagagggagatgaagacgatgacgacgatggctctgaggggacctcaggggctgccgagctgggggggcgctcaagctgcgaggatccgggctgcccgcgagacgaggagcgggcgccaggatggggtcgatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggcagggggtgcccaggtggtggctcgaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgcaagtcttacg

SEQ ID NO: 2829 - DNA, 1501 bp, Homo sapiens
agcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacacttt

SEQ ID NO: 2830 - DNA, 1932 bp, Homo sapiens
atgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgccggtatcgtaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctcggcaggctgcgcacagcctgtgagcgcgccaagcgcaccctgtcctccagcacccaggccaccctggagatagactccctgttcgagggcgtggacttctacacgtccatcactcgtgcccgctttgaggaactgtgctcagacctcttccgcagcaccctggagccggtggagaaggccctgcgggatgccaagctggacaaggcccagattcatgacgtcgtcctggtggggggctccactcgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacctttgacattgatgctaatggcatcctgagcgtgacagccactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtggcactcaagcccgccagggggaccccagcaccggccccatcattgaggaggttgattga

SEQ ID NO: 2831 - DNA, 2035 bp, Homo sapiens
cgagccccgccgaaccgaggccacccggagccgtgcccagtccacgccggccgtgcccggcggccttaagaaccaggcaacctctgccttcttccctcttccactcggagtcgcgctccgcgcgccctcactgcagcccctgcgtcgccgggaccctcgcgcgcgaccagccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatgggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagcgaaaattgcactaaatgaatctcgttccaaagaactaccccttttcagctgagccctggggactgttccaaagccagtgaatgtgaaggaaactcccctccttcggggcaatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggggcccaccaccccctcaagccccagcagccctcaacaggcccagggagggaagtgtgagcgccttggtatgacttaaaattggaaatgtcatctaaccattaagtcatgtgtgaacacataaggacgtgtgtaaatatgtacatttgtctttttataaaaagtaaaattgtt

SEQ ID NO: 2832 - DNA, 4068 bp, Homo sapiens
gaattcctcctctcttcaccccgttagctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttcacccgaattttgactgtttcatttagaagaaaagcaaaatgagaaaaagctttcctcatttctccttgagatggcaaagcactcagaaatgacatcacataccctaaagaaccctgggatgactaaggcagagagagtctgagaaaactctttggtgcttctgcctttagttttaggacacatttatgcagatgagcttataagagaccgttccctccgccttcttcctcagaggaagtttcttggtagatcaccgacacctcatccaggcggggggttggggggaaacttggcaccagccatcccaggcagagcaccactgtgatttgttctcctggtggagagagctggaaggaaggagccagcgtgcaaataatgaaggagcacgggggcaccttcagtagcaccggaatcagcggtggtagcggtgactctgctatggacagcctgcagccgctccagcctaactacatgcctgtgtgtttgtttgcagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgctacagtccctggccctgcttcccatcctcctctcttcaccccgttagctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagtcttttacttttgtatagcttgataggggcaggggcaatgggatgtagtttttacccaggttctatccaaatctatgtgggcatgagttgggttataactggatcctactatcattgtggctttggttcaaaaggaaacactacatttgctcacagatgattcttctgattcttctgaatgctcccgaactactgactttgaagaggtagcctcctgcctgccattaagcaggaatgtcatgttccagttcattacaaaagaaaacaataaaacaatgtgaatttttataataaaaaaaaaaaaaaggaattc

SEQ ID NO: 2833 - DNA, 664 bp, Homo sapiens
ggattgttggtctgcgtggaacttctcaggtggacaccagagcatggaacacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgctttcttaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggacgtgccgggtttatcattgctttgttatttgtaaggactgaaatgtacaaaacccttcaat

SEQ ID NO: 2834 - DNA, 615 bp, Homo sapiens
gctcagagagaagtgactttgagctcacagtgtcaccgcctgctgatgggagagctgaattcaaaaccagggtgtctccctgagcagagggacctgcacacagagactccctcctgggctcctggcaccatggccccactgaagatgctggccctggtcaccctcctcctgggggcttctctgcagcacatccacgcagctcgagggaccaatgtgggccgggagtgctgcctggagtacttcaagggagccattccccttagaaagctgaagacgtggtaccagacatctgaggactgctccagggatgccatcgtttttgtaactgtgcagggcagggccatctgttcggaccccaacaacaagagagtgaagaatgcagttaaatacctgcaaagccttgagaggtcttgaagcctcctcaccccagactcctgactgtctcccgggactacctgggacctccaccgttggtgttcaccgcccccaccctgagcgcctgggtccaggggaggccttccagggacgaagaagagccacagtgagggagatcccatccccttgtctgaactggagccatgggcacaaagggcccagattaaagtctttatcctc

SEQ ID NO: 2835 - DNA, 885 bp, Homo sapiens
agcctacgcacgaaagtgactagggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcatattttgttgcggagttcataatgaataacacaggagaatggataaggcaaaacggaggctgggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctct

SEQ ID NO: 2836 - DNA, 1875 bp, Homo sapiens
aaagcatccagttcctttgcggtcctcttcttcagcacatgccaaagctgttcctcacggcctgtgagacaagagcatcttggatgtaggacaatggaagagttagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcagctcgtgtatactaccaatatccaggagctcaatgtctacagtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctggagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttgccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataaaaaaaaaaaaaaaaaaaaaaaaaaaaaaaaaaaaaaa

SEQ ID NO: 2837 - DNA, 2366 bp, Homo sapiens
gaccacgcgtatcgatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaagatgaggaggaagagtgcaaagaggaggcagagacccagagcgggtcctgctgcccttccacttccctggcagtttcgtggaggagatgagtgacagccggcgctacagcctggcagatctgactgcccagttttcaatgccttgtgaggtcaaggtggtggccaaggacaccagccaccccaatgaccctcagaacctccttcctgggcctgcggctggaggagaagatcacagagccattcttggtggtgagcctggactctgagctgggatgtgctttgagatccctccccggaggctggacctgactgtcgtggaggccaaggggcagccagacttgccagaggggtctctccccatagccacagtggaggaagctggaacagacaccttttattattgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgttcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcc

SEQ ID NO: 2838 - DNA, 6383 bp, Homo sapiens
cgcggccgctatatataatgcagcatcacaccatgtagggcatttactcttattttatacattcagatatgtttgaaacattcttaaggctacaaaacagaacatagaaaaataaacaggaatatattcaacacttacaaaaagtgatatgataaagaatataaagtactagtttccttttaacacttcaaaagatatgtatatatacttttttttacaagtaacatcacaaatgctcacatcttcacatgctcttaaagtattatttgtactcagtgtaaggctattatcgtttttcatacataaaattttctagctctgtaacacaatgcaatttttaatccattcaagtaagttcaaccccaaagttgccgcttcccagcattaagacatgcacccacccctcttctaagattttctaaacttgtatttcggggagaaagacctcttttaaaaaataatccaattagtgggagagtaaatggctgacattagtagcaaaaccttagttatctgaaaataacatattggaaatgagacattattaggattttaaacaaacaatagcatttagacataaagtaggaagcaaaatacagtaaacagaaatagtgtagccaaatatcattctcttcagctaccttaagtaaaagacaaaacatttacctcatctaaaaatgaaggtaaaacgaaagaggcaaaaataaatattgctagtttctaggatggctgaatgttttctaaaccagaaatggttagaaaggaactttattgcaccaagtcaatcataagcaagtttgcagttcacaggcattttaattcaaccttgagtcacaaaggagaacaacacgctgcgagaatacagtctacagtctgcattaaataagaatatatcagcattgtggtctgggaaaacctatgcttgccaggacaaggcagggtgctgagcttaggtcatgccatgaaaatgaatttgtgggttatcagtaaacagtatgaggactacacagatgccagcatcctgctgccaaggagacatggggcaagagttgaagatttgagaggaaatgaagagacatacacaacaccaaaggaaaagggggctggaatcaagttcagccaaagcacctaacacaaaaaacaggtgagctttggtcagtctgttcttcaaaatatgtatgatcatatggtaatgaagtttcataatttccaactcaaaaatacaaatgatcctcagttctatacttttgcctctattctcttataaagaaatatgtcaacataacagtatgacataacagttaaaataaggacaaaagcttgcttatcttagtttgacctcagcataaggcaaaatcccctggagaatacatttaaaaacaaacttaaaaggaaaaaaagcgaaaccaacttcatgcaaagattccttttaaaactatcaaaagtcagttcttttattccagaggtcactgagaaaagtaccatctgctaaaattctctttcaagcacttcttccatcatatcctagaggtgagatatgggaaacagaaagcaaatcagtgttcctcaggagctatatctgttactcaattgagggtaagacaaagtgacaatgaagatatgagtagtatttccttccaatttttaaagattttcagaagctgagatcaaaccccactcaataaaatgcaggagactagaagcaacaacttattttggactcctgagatcaaacacattgaactttcaaatctgggtgtttctatcaaaatgtgattttcattaaaatcagtaagctagtcctacataaaaaagcatgagctgaaagtggaggaccctctatcttctcattccttaactgagccaccgatgttaagaaaaaaatggcttaagcggtaccttcaacaactattctagttaagaaggtgacaacaaattgaggccgcgaattcggcgaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatgggaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaacgaggaataataacagtttggtgcctaaatatcatcctaatttctggatggatgggaagtggaggtgctgttctcagctggagaagcttgcaacaggctgtgcccaatatgatccaaccaagaatgcttcaaagaagcctcttcctcctactcctgaagacaacaggcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggcatgaaggatatgtaccaagcagttatctggtggaaaaatctccaaataatctggaaacctatgagtggtacaataagagtatcagccgagacaaagctgaaaaacttcttttggacacaggcaaagaaggagccttcatggtaagggattccaggactgcaggaacatacaccgtgtctgttttcaccaaggctgttgtaagtgagaacaatccctgtataaagcattatcacatcaaggaaacaaatgacaatcctaagcgatactatgtggctgaaaagtatgtgttcgattccatccctcttctcatcaactatcaccaacataatggaggaggcctggtgactcgactccggtatccagtttgttttgggaggcagaaagccccagttacagcagggctgagatacgggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggctgccagaaattgtttggtgggagaaaaccaagtcatcaaggtgtctgactttgggatgacaaggttcgttctggatgatcagtacaccagttccacaggcaccaaattcccggtgaagtgggcatccccagaggttttctctttcagtcgctatagcagcaagtccgatgtgtggtcatttggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagagagaccagaagatcggccagccttctccagactgctgcgtcaactggctgaaattgcagaatcaggactttagtagagactgagtaccaggccacgggctcagatcctgaatggaggaaggatatgtcctcattccatagagcattagaagctgccaccagcccaggaccctccagaggcagcctggcctgtactcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgacgtaagacccagattgctatttttattgttatttttcaacagtgaatctaaagtttatggttccagggactttttatttgacccaacaacacagtatcccaggatatggaggcaaggggaacaagagcatgagtgtttttccaagaaactggtgagttaagtaagattagagtgagtgtgctctgttgctgtgatgctgtcagccacagcttcctgccgtagagaatgatagagcagctgctcacacaggaggccggatatctgataagcagctttatgaggttttacagagtatgctgctacctctctccttgaagggagcatggcagacccattggatggattggggtgaacagttcaggtcccatgcttggagcattgggtatctgatgtctgcaccagaacaagagaacctctgacggtggagaaccatgtggtgtaagaagagatcttaggtctcttctttataccaagctcatgttttataccaagctcatcttttataccaagctgtgcaggtgactatgcctcctcttctgcacagaatgcttccaccagcatcctgagaagaaatgattacttctgtaaaacatccttttttccagcctctgggaatcagcccccccctctctgcactatccgatcctcatcaacagagggcagcattgtgttggtcagtgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattatttattcctattagacactggcttctactgaaaatgaaacttattgcagagggaataaatacaaagatggaaagccagtaaagaagtcagtatagaaccactagcgatagtgttgctctggcacagaccactgtggttgatgcatggccctccaacttggaataggattttccttttcctattctgtatccttaccttggtcatgttaatgactttggagttattcagttcctgaccctttaattctcacaaccaaccagtcatgttgcttgaagccattatagacgagcttcaaagcaactttaaaagattgttatgtagaagtatgagttcttcctttaattatcattccaactttcagctgtagtcttcttgaacacttatgaggagggaggacattccctgatataagagaggatggtgttgcaattggctctttctaaatcatgtgacgttttgactggcttgagattcagatgcataatttttaattattgtgaagtggagagcctcaagataaaactctgtcattacgaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctgggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaatacctgttatcctttgtagagcacacagagttaaaagttgaatatagcaatattaaagctgcattttaa

SEQ ID NO: 2839 - DNA, 1531 bp, Homo sapiens
agtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattg

SEQ ID NO: 2840 - DNA, 4446 bp, Homo sapiens
tgccttgaccaggacttgggactttgcgaaaggatcgcggggcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattatttaagaacaaaaaaaaaaaaaaa

SEQ ID NO: 2841 - DNA, 1714 bp, Homo sapiens
ggggcattttgtgcctgcctagctatccagacagagcagctaccctcagctctagctgatactacagacagtacaacagatcaagaagtatggcagtgacaactcgtttgacacggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcggaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaatagtaataatttttcttggatttatgttctgtatctgtgaaaaaataaatttcttataaaactcggaaaaaaaaaaaaaaaaaaaaaaaaaaaaa

SEQ ID NO: 2842 - DNA, 2665 bp, Homo sapiens
ggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgccgaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacaaaacattggatcatgacatgtcgggcgatgcttggaaaagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcaaacagaacttctctgggatgctgggattcttgcctgtatgaatgcatcaagtattcatttattgcccgaataggcattgcattaagtcctctgttaggtgtcaggcaagccaaaaaaaaaaaaaagatgctaagtcctaacccccaacagaagtgttcacagtgtagacgggaaaaaatgtataaacaaatgtgtaaaaagagaaatcagctcatggcttaggatggaattagagacaggtgagggacactcaggagctcattttccagctgctcttcagagtggaagggctggctggatcgggtaggtaagaatagctggattttttagaaaagaaatggatacagtctaaagaattaactcacccggtactttattctaagaagggtctggcatccatatgaggaaaaatgctcagctccaggaaagatggggagtccaagtggattaatgatgtcatgcataattttaagagacaagggagaaaacacaatgtatagccagagaaggagaagctcccatccaaatcctactaggaagagagtgggctgcagatgaatctgtgactcatgtttccctgtttcaaagggatcctggggaaggaggggaacatgcttgcagtatctctccctgtctgtctgctcacataagcattccgtccatctaagctcatcgtgctactggtatgtgtatgtgcagttacacagtttcctgtatcataaatcctagtgtgtttatacaaggagacatctgtggtttccccaaccgttccaaaaggctatttcaaaggaaccagcccacgtatgagaaatgaatgtaacactgtggacattgacttcccgcataaggcagggtgaccccctgaactccagatgtttgcacagtatcttatgtgttgttttccgttgtgacgaatgtgattggaacatttggggagcacccagagggatttttcagtgggaagcattacactttgctaaatcatgtatttattcctgattaaaacaaacctaataaatatttaacccttggc

SEQ ID NO: 2843 - DNA, 1061 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtgaaacgttactactctgttgtatatccaggctggcccatatatccacgtaacagatacacttctctctttctcattgttaattcagtaattctaatactgtctgttataattaccattttggtacagctcaagtaccctaatttagttcttttggactaatacaattcaggaaagaaaaaacccaaaaaccaacctcattcacatatggcttttttttaaccaataacaattaggtgtacttctattttaaaacatttcagaaaaaaatatatgttatagcaatactcttac

SEQ ID NO: 2844 - DNA, 2088 bp, Homo sapiens
gaattcggcacgagcgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggaggcaaggatcgggaagcgttcgaggccgagtatcgactcggccccctcctgggtaaggggggctttggcaccgtcttcgcaggacaccgcctcacagatcgactccaggtggccatcaaagtgattccccggaatcgtgtgctgggctggtcccccttgtcagactcagtcacatgcccactcgaagtcgcactgctatggaaagtgggtgcaggtggtgggcaccctggcgtgatccgcctgcttgactggtttgagacacaggaaggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctccccagactgctgtgccctaatccgccggtgcctggcccccaaaccttcttcccgaccctcactggaagagatcctgctggacccctggatgcaaacaccagccgaggatgttacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtttgcccagttcccttcccaatcctacaaaggagccttcctcccagaacctgtggtccctgattttggagggggaacttcttgcttctcattttgctaaggaagtttattttggtgaagttgttcccattttgagccccgggactcttattttgatgatgtgtcaccccacattggcacctcctactaccaccacacaaacttagttcatatgcttttacttgggcaagggtgctttccttccaataccccagtagcttttattttagtaaagggaccctttcccctagcctagggtcccatattgggtcaagctgcttacctgcctcagcccaggattttttattttgggggaggtaatgccctgttgttaccccaaggcttctttttttttttttttttttttgggtgaggggaccctactttgttatcccaagtgctcttattctggtgagaagaaccttaattccataatttgggaaggaatggaagatggacaccaccggacaccaccagacaataggatgggatggatggttttttgggggatgggctaggggaaataaggcttgctgtttgttttcctggggcgctccctccaattttgcagatttttgcaacctcctcctgagccgggattgtccaattactaaaatgtaaataatcacgtattgtggggaggggagttccaagtgtgccctccttttttttcctgcctggattatttaaaaagccatgtgtggaaacccactatttaataaaagtaatagaatcagaaaaaaaaaaaaaaaaaaa

SEQ ID NO: 2845 - DNA, 1666 bp, Homo sapiens
atttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaa

SEQ ID NO: 2846 - DNA, 850 bp, Homo sapiens
gaattccggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagaatgagtaatttataaataaaagagatttaattgaaaaaaa

SEQ ID NO: 2847 - DNA, 761 bp, Homo sapiens
atccccacccaaagcctgatggaccccggctggccatgctgtcccctccctgtggcgtttcttagcagatggctgcagagcttcgttgatggtcttttctgtactggaggcctcctgaggcagcgaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagtttggagaaaaaaaaaaaaaaaaaaaaaaaaaaaa

SEQ ID NO: 2848 - DNA, 5426 bp, Homo sapiens; identical to SEQ ID NO: 2814

SEQ ID NO: 2849 - DNA, 2206 bp, Homo sapiens
cgcggggccagggcggcggcccccagggagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctaacaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggatggtcatgaggagctgaaggccatcgtatggaataatgatctcctttgggaagactacgaggagaaactggctgaccaggctgtaaggaccatggaaatctatgttgcccagttcagtgaaattaaggagagaattgccaagcggggtcggaaactcgtggactatgacagtgcccgacaccacctggaggcagtgcagaatgccaagaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctgactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgactaaaaaaaaaa

SEQ ID NO: 2850 - DNA, 1712 bp, Homo sapiens
cagttagcttcaaacaaaaacgaaagttagaccaagggaacgtattagatatggaagtaaagaaaaagaaacatgataaacaagaacagaaaggaagtgtgggagctacattcaaattaggtgactctttgtcaaacccaaacgaaagagccattgttaaagaaaagatggtatcaaatactaagtctgtagacacgaaagcgagttcatctaaatttagtagaattctaactcctaaggagtatttacaaaggcagaagcataaagaagctccgagtaataaagcatcgaagaaaatctgtgtgaaaaacgtgccatgtgattctgaacatatgagaccaagtaaacttgccgtgcaggttgaaagttgtgggaaatcaaatgagaaacacagcagcggcgtgcagacctctaaagaatcattaaatggcttgacaagccatggtaaaaacctcaaaatccaccattctcaggagtctaaaacatacaacattctaaggaatgttaaagaaaaagttggtgggaagcagcctgataaaatatggattgataagactaaattagacaaattaaccaatataagcaacgaagctcaattcagccaaatgcctccccaagtaaaggatcaaaagaaattatatctgaatagagttgggtttaaatgcactgaacgtgaaagcatttctctcaccaaattagaaagttcacccaggaagcttcataaagataagagacaggaaaataaacataagacctttttaccggtgaaaggtaacacagaaaaatcaaacatgctggagtttaaattatgtccagatatcttactaaagaatacaaactctgtggaagaacggaaggatgtaaagcctcatcctaggaaggagcaagcccctctgcaagtttcaggaataaaaagtacaaaagaagactggttaaaatttgttgctacaaagaaaaggacacagaaagacagccaagagagagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcccactttcattgtatttcattgaaagtgcttaattaaaatggcttgagaactttgggtagccatgtgtaagaaatggatggtattcaccggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaacgcccactgtgatgtgaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaact

SEQ ID NO: 2851 - DNA, 1726 bp, Homo sapiens
tttttccagtgaaacaaaacgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagattcggcaacacaccagtgcaacaaagactcagctgcctggccaaggacaactctatctatgtcgtggctaatattggggacaagaagccatgcaatgctagtgactctcagtgtccccctgatggccgttaccaatacaacactgatgtggtgtttgattctcagggaaaactgttggcacgctaccataagtacaatctttttgcacctgaaattcagtttgatttccccaaggattcagaacttgtgacttttgacactccctttgggaagtttggcatttttacttgctttgacattttttctcatgacccagctgcggtggtggtggatgaagtttcaattgacagcattctctaccccacagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtgatctcctttagcagagcccttttaggattagcctggctaagaaaggaagaaaaaaaagagatccgttagtgtctgtttagaaaagatgttataaacttacagaaacaaatataataaactgaagcagatttgaaaagcaaaaaaaaaaaaaaaaaaa

SEQ ID NO: 2852 - DNA, 7603 bp, Homo sapiens
ttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 2853 - DNA, 3869 bp, Homo sapiens
gagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactgggactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaataaaaaaaaaaaaaaa

SEQ ID NO: 2854 - DNA, 3498 bp, Homo sapiens
cgggagtagcgcagtcgccaaagccgccgctgccaaagctgccgccactagccgggcatggccatggcgtccccggccatcgggcagcgcccgtacccgctactcttggaccccgagccgccgcgctatctacagagcctgagcggccccgagctaccgccgccgccccccgaccggtcctcgcgcctctgtgtcccggcgcccctctccactgcgcccggggcgcgcgaggggcgcagcgcccggagggctgcccgggggaacctggagcccccgccccgggcctcccgacccgctcgcccgctccggcctggtctgcagcagagactgcggcggcggcctggagcgccccgaccccgcgacgtgcggagcatcttcgagcagccgcaggatcccagagtcccggcggagcgaggcgaggggcactgcttcgccgagttggtgctgccgggcggccccggctggtgtgacctgtgcggacgagaggtgctgcggcaggcgctgcgctgcactaactgtaaattcacctgtcacccagaatgccgcagcctgatccagttggactgcagtcagcaggagggtttatcccgggacagaccctctccagaaagcaccctcaccgtgaccttcagccagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgagggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaatgaaaaaaaaaaaaaaaaaa

SEQ ID NO: 2855 - DNA, 1505 bp, Homo sapiens
gctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggtttttt

SEQ ID NO: 2856 - DNA, 5220 bp, Homo sapiens
cagtcgctccgagcggccgcgagcagagccgcccagccctgtcagctgcgccgggacgataaggagtcaggccagggcgggatgacactcattgattctaaagcatctttaatctgccaggcggagggggctttgctggtctttcttggactattccagagaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcaactacccgctctgccagttccagtacatctgcagctgcctgcacagtgggttgacccctcacctgaccatggtccattcctcctccatcctcgccatgcgggatgagcagagcaaccctgccccccaggtccagaaaccgcgtgccaaaccacctcccattcctgcgaagaagccttcctctgtgtccctgtggtccctggagcagccgttccgcatcgagctcatccagggcagcaaagtgaacgccgacgagcggatgaagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggactgccccattgcctgggccaacctcatgctgtttgactacaaggaccagcttaagaccggggaacgctgcctctacatgtggccctccgtcccagatgagaagggcgagctgctgaaccccacgggcactgtgcgcagtaaccccaacacggatagcgccgctgccctgctcatctgcctgcccgaggtggccccgcaccccgtgtactaccccgccctggagaagatcttggagctggggcgacacagcgagtgtgtgcatgtcaccgaggaggagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccagatgctctacctgctgtgctcctggccggagctgcccgtcctgagcgccctggagctgctagacttcagcttccccgattgccacgtaggctccttcgccatcaagtcgctgcggaaactgacggacgatgagctgttccagtacctgctgcagctggtgcaggtgctcaagtacgagtcctacctggactgcgagctgaccaaattcctgctggaccgggccctggccaaccgcaagatcggccacttccttttctggcacctccgctccgagatgcacgtgccgtcggtggccctgcgcttcggcctcatcctggaggcctactgcaggggcagcacccaccacatgaaggtgctgatgaagcagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctgcgtggagcagtgcaccttcatggactccaagatgaagcccctgtggatcatgtacagcaacgaggaggcaggcagcggcggcagcgtgggcatcatctttaagaacggggatgacctccggcaggacatgctgaccctgcagatgatccagctcatggacgtcctgtggaagcaggaggggctggacctgaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccgggggaggccctggatcgagccattgaggagttcaccctctcctgtgctggctattgtgtggccacatatgtgctgggcattggcgatcggcacagcgacaacatcatgatccgagagagtgggcagctgttccacattgattttggccactttctggggaatttcaagaccaagtttggaatcaaccgcgagcgtgtcccattcatcctcacctatgactttgtccatgtgattcagcaggggaagactaataatagtgagaaatttgaacggttccggggctactgtgaaagggcctacaccatcctgcggcgccacgggcttctcttcctccacctctttgccctgatgcgggcggcaggcctgcctgagctcagctgctccaaagacatccagtatctcaaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaacggaaacgcctccttcattcagcggcggtgctgggccccccgaggctgcacctggctctcggctgaggattgtcaccccaagtcttccagctggtggatctgggcccagcaaagactgttctcctcccgagggaaccttcttcccaggcctcccgccagactgcctgggtcctggcgcctggcggtcacctggtgcctactgtccgacaggatgcctcgatcctcgtgcgacccaccctgtgtatcctccctagactgagttctggcagctccccgaggcagccggggtaccctctagattcagggatgcttgctctccacttttcaagtgggtcttgggtacgagaattccctcatctttctctactgtaaagtgattttgtttgcaggtaagaaaataatagatgactcaccacacctctacggctggggagatcaggcccagccccataaaggagaatctacgctggtcctcaggacgtgttaaagagatctgggcctcatgtagctcaccccggtcacgcatgaaggcaaaagcaggtcagaagcgaatactctgccattatctcaaaaatctttttttttttttttttgagatggggtcttcctctgttgcccaggctggagtgcagtggtgcaatcttggctcactgtaacctccgcctcccaggttcaagtgattcttcttgcctcagcctcctgagtagctgggattacaggtgtgcaccacccgtacccagctaatttttgtattttagtagagacgggggtttcaccatgttggctgggctggtctcgaactcctgacctcaggtgatccacccgcctgagcctcccaaagtgctgggattacaggcatgagccaccacgcccggcccactctgccattgtctaagccacctctgaaagcaggttttaacaaaaggatgaggccagaactcttccagaaccatcacctttgggaacctgctgtgagagtgctgaggtaccagaagtgtgagaacgagggggcgtgctgggatctttctctctgactatacttagtttgaaatggtgcaggcttagtcttaagcctccaaaggcctggatttgagcagctttagaaatgcaggttctagggcttctcccagccttcagaagccaactaactctgcagatggggctaggactgtgggcttttagcagcccacaggtgatcctaacatatcaggccatggactcaggacctgcccggtgatgctgttgatttctcaaaggtcttccaaaactcaacagagccagaagtagccgcccgctcagcggctcaggtgccagctctgttctgattcaccaggggtccgtcagtagtcattgccacccgcggggcacctccctggccacacgcctgttcccagcaagtgctgaaactcactagaccgtctgcctgtttcgaaatggggaaagccgtgcgtgcgcgttatttatttaagtgcgcctgtgtgcgcgggtgtgggagcacactttgcaaagccacagcgtttctggttttgggtgtacagtcttgtgtgcctggcgagaagaatattttctatttttttaagtcatttcatgtttctgtctggggaaggcaagttagttaagtatcactgatgtgggttgagaccagcactctgtgaaaccttgaaatgagaagtaaaggcagatgaaaagaaaaaaaaaaaaaaa

SEQ ID NO: 2857 - DNA, 1158 bp, Homo sapiens; identical to SEQ ID NO: 2801

SEQ ID NO: 2858 - DNA, 6807 bp, Homo sapiens
tctagagtaagaaactagctgagcaacgtggtgtcacactatacacccattaagacaacaggcacatgtgtcatgtccattttgtggaaaagatatgtaaaataattttaagtaaaaaagataaatataaaaaagtgaatgcatacaaaacaatttcacaaaattgaatgttactcaaaaatcacagctcattttaagctgcacaaaatagtcatttttttctttataattgctcaaattcataatcaaacagaagaaagttcctgtcttggaagtagtgctatgccccaattcttccagagccagtactttaaacaattccatttcattattttcctgtagactaattcttaggacatcagcatatctctcttcaagcattaaaaaaatctctttagagtcagtggatcaatagacagttcctgttttccacacaactgaaagggtggagcccccaaaccacaaggggaagaaggaagttaaaagatgttaaatactggggccagctcaccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactgtaagtctactctccataattccagagaattagctacgtatggaacagacactaggagagaaggaagaagaagaaggggctttgagtgaatagatgttttatttctttgtgggtttgtatacttacaatggctaaaaacatcagtttggttctttataaccagagatacccgataaaggaatacgggcatggcaggggaaaattccattctaagtaaaacaggacctgttgtactgttctagtgctaggaagtttgctgggtgcctgagattcaatggcacatgtaagctgactgaaagatacatttgaggacctggcagagctctctcaagtccttggtatgtgactccagttatttcccattttgaacttgggctctgagagcctagagtgatgcagtatttttcttgtcttcaagtcccctgccgtgatgtgggatttttatttttatttttattttattttattttatttttaaagacagtctcactgtgtggcccaggctggagtgcagtggcatgatctcagctcactgcaacctctgccttctgggctcaagtgattctcgtgcttcagccttctgagtagctgtgactacaggtgtgtaccaccacacccagctaattttttgtattttcagtagagatggggtttcaccatgttggccaagctggtcttgaactcctggcctcaaatgatctgcccacctcagcctcccaaagtggtaggattacaggtgtgaaccactgcacccagccgacatgggatttttaacagtgatgtttttaaagaatatattgaattccctacacaagagcagtaggaacctagttcccttcagtcactctttgtataggatcccagaaactcagcatgaaatgttttattatttttatctactctacttgattaactatctttcattttctcccacacaattcaagatgtgccatgaggaaaagttattttatagtttagtacatagttgtcgatgtaataatctctgtagttttcagattgaattcagacatttcccctcaatagctatttttgaatgaatgagtgaagggatgaaatcacggaatagtcttgttttcaagattctaacttgatatccaaattcacctttagatattataagaaaatttctatcagaaaatccttatgtttttctgattaaaaaaagcatttttccatcagcctatgtatctgctatgaatttacaaaatctactcaacagctctgttgatttttctgttcttggctgaatgttgcctgagggatgggagcacgggaagggtaaaagcaatggaagaaacatgtattttaatattttaaaagtatgttatattgttcgttggtgttacaagatgatttgcattacaaaaggattctcttacaagtcccttatcttaacactaaagtgctaagatattttataagtaaatctttatacttataaaacaaatcagtaaaatagaagtagctaagtagaactgattttgctatagagtataagtcacttagtgttgctgtttattactaaaaataagttcttttcagggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtggtaagacaagctaatatttgaccaatctggttatacttacaagaattgagactcaatacaaatgaaaaagccttgaaaggttcatgagggacctagaaaaactacatctcaacttccagaaagtcattattattttcctcataattccctgagtaagaaatttaaagaagtggtatcataaaaggttgatgttttttaatatacagaagtttctggaatgacctattaatttactgtcaatggccttactgatgctttgtccagaacaatgccattgctcctgcttactttggggaggttttgggataatttagttgtatggtcctttttcaattgttttacttttttttttatgaaatgttctaaatgtatagaaaattagagacattagtataataaacagccatatgcccattatgcactttaaaagttgttaacattttgccatagttgcttcttctatgcctttttttttttttttttttttttttgctgagagttttttgtttggttttgttttgttttattttgagacagggtctcctgtccccaggctgtagtcagtggcaccatcacagctcactgcagctcaagtgatcatcccaccacagcctcccaagtagctgggactacaggtgtgcaccaccatgcctggcaaatttttgaaatttttagtacaggcaaattctgtgttgcccaggctggtcttgaactcctgagttcaagcaatcttcccacctcagcctccttaagctgctggaattacaggcgttagcactgtacctggctactgctgagagacttttaagtgaattaggaacatgatgatattccatttctaaattctttagtttacatcttcaaaaaatacagttcctgtagaattattattgtaaataacaaattaacttaaggatttatttatttggagtgaaacaaatattttactgaactcataaaaatagaaataccatgtggaatcctcagtgtcaaaaatattgcagaaatcttgcaaagttgatattattaaattgttaaatattaaaattcccaataaagaacattaatcttatttctaaaatccagttaattaaaaaaatttatattatataataatatttggtcattaaataaaaattagaaaatacaaataagaaaaataacacccataatcttactacccagaggtttataaccatgggtaaattctggtatatattcttccagaatgtatatcaatcatgtgtatgaatgttaaattatatcatacacatataaacccacatacaaacatgtaaatactgtgtgcttttgcaaaaattaaattgtattatacacacggctttacaatttgcttcttatcacacaaaattatttgcatgtcagcaaatacaaatcggtttttaatgatcttttgctccattttccagatgagaaaaaaatacaaatctgtatcatcattttaaaagaatgactagaattttaatatatgaatattctataatttactgatccaattgttactattgagcacttaggttgtttccatttttccctcataaattgctatgaatagctttttgtatacatctttgggtgcatttcttatttcttttggataaattttcaataatagaactgctgagtaaaatatcactaggtgtttttttacagtgtctagtgcaaagaagacctttaatcattttgttaatacttccagagcttccaatgactttggtaaatgaagaaaaaaatgcttcatttcatgctgaatgggagagaatgaagagagttttccccaacaattacacatatatggactcatagaaaataatatcttaccattctttccacagcctaacagaaaaaagctggctaaacctaaatttaaaataaaatatctattaaagtttttattccttaccacctgtctttcagctttgctgcaagataacatcgctgatgctgtagcttgtgcaaagagggttgtccgtgatccacaaggcattagagcatggtatgttttaagtgttaaaagggaaaactatcttactctactgttgatatatacaatgagagcagacttttaaagaccaaagtatgctaatgacacctcaaaattgcagcttttggcttatgctaaatgatgtattacctacatccttgaagaaacaatctactttaactgatccagaatcttactcttttactcctcaatttattttaggggatttctagagttttaagatgcttcacactctatcagttccttgtcatatcttgaaattctttttagaataagtaagtgtgggccgggcacagtgctcacgcctgtaatcccagcactttgggagaccgaggcagatggatcacctgaggtcaggagttcgagaccagcctgcctaacatggcaaaaccccatctccactaaaaatacaaaaaattagctgggtgtggtgcaggtgcctgtaatcccagccactcgggaggctgaggcaggagacttgcttgaacccgggaggtggaggttgcagaggattgcgccattgtacttcagcctgggcgacagagtgagactctgtctcaaataaatagcataaaaaataaacgtggaattcactttgcagttgctgctgtacaacgcacattactcaatctttatgttcggcattctatgctctactgagaaatttgggtaggagtgaagtattttgtatacatatcttcatttaataaatagcaatagctgggtctatcttactattttatctattgataaaatattttgtttccccaaggagtgcgaagtatgtatattacaatgaagatatgttttaacctttcaccatttgcttcatctttttctacagggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttcttttttttttttttttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgattttttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacacatgccttgtctgtttttatttagactcctatagtgtctctgaagaaaagaatacagatatttgaaaaaatatgatttggtgctcttaatatctcttatatcgtcacttacctcacttaaatagtcagatattgctggagaaaaattcacaagcatgctgacaggtctcactttaaattcataaccataaatctcaaatgagccctcaagtctgcctgaccattttagttacttctctacaatccttccatttttatgtccctagtctccaaaatgactgttactattttacttttcctcttctctcttcaaagcctcaagacacacattcagcctcctcctctgcccccttatcctccaccctcctctgctctcagcagataaactggcctcatattacacttctaaaacaaaagcaacttcataccaagctt

SEQ ID NO: 2859 - DNA, 1497 bp, Homo sapiens; identical to SEQ ID NO: 394

SEQ ID NO: 2860 - DNA, 3151 bp, Homo sapiens
cccggccagacaccctcacctgcggtgcccagctgcccaggctgaggcaagagaaggccagaaaccatgcccatggggtctctgcaaccgctggccaccttgtacctgctggggatgctggtcgcttcctgcctcggacggctcagctggtatgacccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttagaaccccagaagacaacacctccaacgacaaggcccccgcccaccacaactccagagcccacagctcctcccaggctgcagctggtggcacagtctggcggccagcactgtgccggcgtggtggagttctacagcggcagcctggggggtaccatcagctatgaggcccaggacaagacccaggacctggagaacttcctctgcaacaacctccagtgtggctccttcttgaagcatctgccagagactgaggcaggcagagcccaagacccaggggagccacgggaacaccagcccttgccaatccaatggaagatccagaactcaagctgtacctccctggagcattgcttcaggaaaatcaagccccagaaaagtggccgagttcttgccctcctttgctcaggtttccagcccaaggtgcagagccgtctggtggggggcagcagcatctgtgaaggcaccgtggaggtgcgccagggggctcagtgggcagccctgtgtgacagctcttcagccaggagctcgctgcggtgggaggaggtgtgccgggagcagcagtgtggcagcgtcaactcctatcgagtgctggacgctggtgacccaacatcccgggggctcttctgtccccatcagaagctgtcccagtgccacgaactttgggagagaaattcctactgcaagaaggtgtttgtcacatgccaggatccaaaccccgcaggcctggccgcaggcacggtggcaagcatcatcctggccctggtgctcctggtggtgctgctggtcgtgtgcggcccccttgcctacaagaagctagtgaagaaattccgccagaagaagcagcgccagtggattggcccaacgggaatgaaccaaaacatgtctttccatcgcaaccacacggcaaccgtccgatcccatgctgagaaccccacagcctcccacgtggataacgaatacagccaacctcccaggaactcccgcctgtcagcttatccagctctggaaggggttctgcatcgctcctccatgcagcctgacaactcctccgacagtgactatgatctgcatggggctcagaggctgtaaagaactgggatccatgagcaaaaagccgagagccagacctgtttgtcctgagaaaactgtccgctcttcacttgaaatcatgtccctatttctaccccggccagaacatggacagaggccagaagccttccggacaggcgctgctgccccgagtggcaggccagctcacactctgctgcacaacagctcggccgcccctccacttgtggaagctgtggtgggcagagccccaaaacaagcagccttccaactagagactcgggggtgtctgaagggggccccctttccctgcccgctggggagcggcgtctcagtgaaatcggctttctcctcagactctgtccctggtaaggagtgacaaggaagctcacagctgggcgagtgcattttgaatagttttttgtaagtagtgcttttcctccttcctgacaaatcgagcgctttggcctcttctgtgcagcatccacccctgcggatccctctggggaggacaggaaggggactcccggagacctctgcagccgtggtggtcagaggctgctcatctgagcacaaagacagctctgcacattcaccgcagctgccagccaggggtctgggtgggcaccaccctgacccacagcgtcaccccactccctctgtcttatgactcccctccccaaccccctcatctaaagacaccttcctttccactggctgtcaagcccacagggcaccagtgccacccagggccctgcacaaaggggcgcctagtaaaccttaaccaacttggttttttgcttcacccagcaattaaaagtcccaagctgaggtagtttcagtccatcacagttcatcttctaacccaagagtcagagatggggctggtcatgttcctttggtttgaataactcccttgacgaaaacagactcctctagtacttggagatcttggacgtacacctaatcccatggggcctcggcttccttaactgcaagtgagaagaggaggtctacccaggagcctcgggtctgatcaagggagaggccaggcgcagctcactgcggcctctaagaaggtgaagcaacatgggaacacatcctaagacacatcctaagacaggtcctttctccacgccatttgatgctgtatctcctgggagcacaggcatcaatggtccaagccgcataataagtctggaagagcaaaagggagttactaggatatggggtgggctgctcccagaatctgctcagctttctgcccccaccaacaccctccaaccaggccttgccttctgagagcccccgtggccaagcccaggtcacagatcttcccccgaccatgctgggaatccagaaacagggaccccatttgtcttcccatatctggtggaggtgagggggctcctcaaaagggaactgagaggctgctcttagggagggcaaaggttcgggggcagccagtgtctcccatcagtgccttttttaataaaagctctttcatctatagtttggccaccatacagtggcctcaaagcaaccatggcctacttaaaaaccaaaccaaaaataaagagtttagttgaggagaaaaaaaaaaaaaaaaaaaaaaaaa

SEQ ID NO: 2861 - DNA, 1653 bp, Homo sapiens
agcgatttcatcttcaggcctggactacaccactcaccctcccagtgtgcttgagaaacaaactgcacccactgaactccgcagctagcatccaaatcagcccttgagatttgaggccttggagactcaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaaataacaactagggacaatacagaacccattccatttatctttctacagggctgacattgtggcacattcttagagttaccacaccccatgagggaagctctaaatagccaacacccatctgttttttgtaaaaacagcatagctt

SEQ ID NO: 2862 - DNA, 2325 bp, Homo sapiens
ttttttaaagtaagatgtttaagaaattaaacagtcttagggagagtttatgactgtattcaaaaagttttttaaattagcttgttatcccttcatgtgataactaatctcaaatactttttcgatacctcagagcattattttcataatgagctgtgttcacaatctttttaggttaactcgttttctctttgtcattaaggagaaacactttgatattctgatagagtggccttcattttagtatttttcaagaccacttttcaactactcactttaggataagttttaggtaaaatgtgcatcattatcctgaattatttcagttaagcatgttagttggtggcataagagaaaactcaatcagatagtgctgagacaggactgtggagacaccttagaaggacagattctgttccgaatcaccgatgcggcgtcagcaggactggcctagcggaggctctgggagggtggctgccaggcccggcctgggctttgggtctccccggactacccagagctgggatgcgtggcttctgctgccgggccgactggctgctcagccccagcccttgttaatggacttggaggaatgattccatgccaaagctttgcaaggctcgcagtgaccaggcgcccgacatgggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccagtgattgccgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggcaaaggagtctgggcccacgacctacaaggtgaccagcacactgaccatcaaagagagcgactggctcagccagagcatgttcacctgccgggtggatcacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcctggacccgccagaatggccaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaaaggggtggccctgcacaggcccgatgtctacttgctgccaccagcccgggagcagctgaacttgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccgagggggaggtgagcgccgacgaggagggctttgagaacctgtgggccaccgcctccaccttcatcgtcctcttcctcctgagcctcttctacagtaccaccgtcaccttgttcaaggtgaaatgatcccaacagaagaacatcggagaccagagagaggaactcaaagggcgcagctccgggtctggggtcctgcctgcgtggcctgttggcacgtgtttctcttccccgcccggcctccagttgtgtgctctcacacaggcttccttctcgaccggcaggggctggctggcttgcaggcacgaggtgggctctaccccacactgctttgctgtgtatacgcttgttgccctgaaataaatatgcacattttatccatgaa

SEQ ID NO: 2863 - DNA, 430 bp, Homo sapiens
gacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggagaataaagttacccttgtactgca

SEQ ID NO: 2864 - DNA, 1824 bp, Homo sapiens
cagctctctgtcagaatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacgggctcccggagcgtgtggagctggcacccctgcctccttggcagccggtgggccagaacttcaccctgcgctgccaagtggagggtgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2865 - DNA, 4882 bp, Homo sapiens
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatacttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttc

SEQ ID NO: 2866 - DNA, 1702 bp, Homo sapiens; identical to SEQ ID NO: 429

SEQ ID NO: 2867 - DNA, 563 bp, Homo sapiens
tgaagagtggaagagacattccagaggaggattgccttcgtcagggtaacggggtgggctgctcaggtgccctacccttcacccccttctgtatcagattggacctcccactcccatctcactctgcgtgtacaatcttccatatccgcaagttcactggcactcttctggcacctgggcaagatcccagaacagaggatggagtgactggcctcacagagcttagtgcccgactcaggggaaatgggactggtgcatgggaaatggtcagcctaggataggacacgagagtctgaaattcaaagcaaccagcttgaagtggtttgagaagctggaagcaaacatgggctagagagatagggcagaagtcaagacgaggatctggactgatgtggagacaagtagccacggaagcatgaactgtatcctgcacaaagtccctcttccccgcctcctaattcattatgcccaaaagtgcttacgtgaaattccagcccagagtactcatgacttgagagacgtggacggagccagcttctaccttgcttggacgtctctcccct

SEQ ID NO: 2868 - DNA, 822 bp, Homo sapiens; identical to SEQ ID NO: 587

SEQ ID NO: 2869 - DNA, 1182 bp, Homo sapiens
gaattccgctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataacc

SEQ ID NO: 2870 - DNA, 537 bp, Homo sapiens
tttttttttttttttttttttctttaaacacacttcatttttttttaaagagttattacatccacacacggttcaaaaatcaaattatgaaaggtatatagttaagactagctgttcaaaacaaaagcagcctttcacgattatgtgagggaacaaagggcaacacccttattagtgccagtttaaaaccttccttcacaccctggactctgccctatgtgcgtcctggttgattttaacctacatcctaacatttaggccagtttcctttcatccttcttacaaatataaaatctcttacccttctctaatattatttggcattccaaaataaggaagtgtcatggttaaaaccaaatcaaaggcaattctgactgtgcacagctcagcctccacccaacctcagaaccactggatcagaccaggttttagtttttttgtacatttacttgataactaagacacaatttgcctacagtgaaatgcttagttctgacacgtatcgctcaatccactgtcaagaattcataacaaagt

SEQ ID NO: 2871 - DNA, 503 bp, Homo sapiens
tttttttttagtataagcatatcccatgcaatttttggaacatatactgaaaaattatactgaaagtcaaatcaaactgatctggcaaccctatctagttacctacaatctaccgtgttcccataaaggctttaagtaatttggaatccgttaacacatttagcttattctttccccattggttccctgggcttagagcagacagcaagcctttctttcacttggccaagaaggcacctccttttcccatctaacaggttgggatcacagctagttggtggcaaagcagtccacatgcatgttgtttatctttttaaggatatggtcatagtttccacccctccttacctctcctgactcaccatctctaagccttcccacacaggccctgctgcagccgccggagaactgaccgtgcttgtgggtccactccctcctcccacatcttccttaagcctcaatccatcccagttcatccatgccctttccaaagtcctgtgatt

SEQ ID NO: 2872 - DNA, 448 bp, Homo sapiens
tttttttttccaataaaaccactgcagatctaaaatactctcttggtttaaaccacacaaaaagcaatttaataggcacaatcctacaggttttctgagagaaataaggaagagatcaagtgtaagctacgtaaaattcacgttttgcaccttataaagcaaacttcaatgttgttaaataaccagtagaaaatatctacaaaaatcaaactaaacacctgttcttataagcagcagtcctctattttctctctaaaccatatattcccaactcagaccctctctgtgacccactgttcccaaagcatagagtctgaagaagaaatataaaacatttcggacattcgttcacaaaaccaaattagacctttccacaaagtacaggagataaaacagaaacacttccattttatctaatttatggcaaatagttcaaggaatgcctatt

SEQ ID NO: 2873 - DNA, 449 bp, Homo sapiens
tttttcttggtcatctacctttaatgtttggtcttaagtcttataaacacatatcatttaatataaaaaaaaaaggatactcacctgaccctttcagatgtttaacgattcgtcttcctcctcggggatgctttttctgaaggatgctggcctggggaaaacagaaccggaagggtaacacctgccatacctaataaaaccaatgagaaatacgaggccccgagatggagtttctgggagattcctgaagagcacgctgtggcgattgagatgatgacgcgtggagctgcccccctccctgtctcccacatcagggacctgtccctctacaggaggaattctactcctgaggccaccgtcccctgtcactcaggtggcctgcatgcacagcacttctggctctgaaagcgtcacctcatggctgtttctgccttcttgctggtgaattt

SEQ ID NO: 2874 - DNA, 3362 bp, Homo sapiens
agactccctgtctttgcggtttgggagatgatgagaaaccacagaattgctagtagtttatgtggagatcaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcgaagattgaagcacgctcatactttgtatgtgctttagggaaggggtgggtgggcacttgggccttgcgggtgcattcatgtaatctgagactcttgaactttatgacggagtcttcaatattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagat

SEQ ID NO: 2875 - DNA, 591 bp, Homo sapiens
ttttctgtttcatcattacaaatagactcatagctctttaatttttccatttaacactttaattttccataggcctagattttcaagaagtccaatatctctcacttgaagtgtcttttccctggagtagattgggagatttgagggatatctgtccaaagatgagacagtctgtttctagtttcccatccagcctgatggggcgtctacagttgttaccacaaggtgtcgctgttgaacagattctggtgcagtctagtgcatagctgtccacttctagagtgatcacttgctgggccaagttcctctccttaagtggtgtctcacattaaggttcccaaattacagactcattaattcaccctaataagctcatccaggcagtttaggtcttcaggggcttccagcctccaacacacattgggccaaaaccagcctgtaccaccagctccaagccctgtgttgaatctaggtcattggtccagatgccccttcattctgggcctgtggtgtcctttccagacagcagacctcagttaagggcatcccagtccatcagagaagttccaggatcacagaccctcaaaaggg

SEQ ID NO: 2876 - DNA, 1437 bp, Homo sapiens
gcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaaccttacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggactggttcatggggccattggaggagctggtgttacagccctgctcgctctttgtctctgcctcatcttcttcatagtgaagacccacaggaggaaagcagccaggacagcagtgggcagcaatgacacccaccctaccacagggtcagcctccccgaaacaccagaagaactccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaaccctcaagagcatcaggctcagctagaagatccacatcctctacaggtcggggaccaaaggctgattcttggagatttaactccccacaggcaatgggtttatagacattatgtgagtttcctgctatattaacatcatcttgagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacaccag

SEQ ID NO: 2877 - DNA, 1182 bp, Homo sapiens; identical to SEQ ID NO: 375

SEQ ID NO: 2878 - DNA, 2412 bp, Homo sapiens
agtcccatggggaatgtcaacaggcaggggcagcactgcagagatttcatcatggtctcccaggccctcaggctcctctgccttctgcttgggcttcagggctgcctggctgcagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtgctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagccccacctgcacgtgatctgctggccctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaagtgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccaccc

SEQ ID NO: 2879 - DNA, 1257 bp, Homo sapiens
aagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcaataaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattg

SEQ ID NO: 2880 - DNA, 2216 bp, Homo sapiens
ggaagctcagcagtgtccactgtcgccattccttggccatagaaaacaatgtatttgaattttgatgtaagcatagcaaattgaagatgaagatgacacgttgatttcttgtttgaaattaaccaagtcccgagaaaagaaagtgaatagtgttagcacgaggaggaaggaagaaatggagattagattggatactctttctgcatcactgggtagatccagcactttaaatgactgcaacttggaagataaattagcttggtatgaaggtgaagcttacatgtggcatcactggaagccttttcctgaaaaccctctctggacatgtcttgatttccaaatagcacaagttggaccctgggactactgctcctcttgtattcgccacacacgtctcaagtcttcctgctcagatatggatctcctacattcatggcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcataaaaaaaaaaaaaaaaaaaaaaaaaaaaaaaaaaaaa

SEQ ID NO: 2881 - DNA, 1847 bp, Homo sapiens
ctcctgccctccactgactccagagagggagatccccagtacttgactccatcacgcagatgggagcaggcaccagctatggagagggatacagctgcgtctccacatgacccatcctgcatgacaccaaagccaccgccagacagtgcctcggattctatgcaaaacctgggaagcggagacctaccccagccccgggaggaagctagctcttcaggggaccgtctgaggactggagtttgatccatgaacctggcttcgaggccttgcttttctctcttcttcattcatattcattcccaacaccttagaaggtgttgcttaatttatttctagaaaagcagcccagagtcagtcattgaagccttccccaccccctggccaaaaaaaaaaaaaaaaaaaaactggacacattttggatctgttgggagcttggagtccagtggttggcatagttgtcacattgggagcagagaagaagcaaccaggggccctgatcaggggactgagccgtagagtcccaggatggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacaggtaatagccctagccattggtgcacaggatgggggcaatgggaggggatgctactgatgggaatgattaagggagctgctgtttaggtggtgctggtttatgttctaggaactcttcatgagcactttgtaaacaccctcttgcttaatcctcccaacggcccccaaaggtagaacttagctcccttttaaaaggagcacattaaaattctcagaggacttggcaagggccgcacagctggggcat

SEQ ID NO: 2882 - DNA, 1841 bp, Homo sapiens
catcaggcacgaggcaggaagtgcacaggcgtccggcgtgctcctccctccctgcagccccgggcagcatctcccagaggctccgcggcccaggctcctggtgtgtctgcagtgcaggtggctcctggaagaccctcagcctgcctgctgaggccatgtcggactacgagaacgatgacgagtgctggagcgtcctggagggcttccgggtgacgctcacctcggtcatcgacccctcacgcatcacaccttacctgcggcagtgcaaggtcctgaaccccgatgatgaggagcaggtgctcagcgaccccaacctggtcatccgcaaacggaaagtgggtgtgctcctggacatcctgcagcggaccggccacaagggctacgtggccttcctcgagagcctggagctctactacccgcagctgtacaagaaggtcacaggcaaggagccggcccgcgtcttctccatgatcatcgacgcgtccggggagtcaggcctgactcagctgctgatgactgaggtcatgaagctgcagaagaaggtgcaggacctgaccgcgctgctgagctccaaagatgacttcatcaaggagctgcgggtgaaggacagcctgctgcgcaagcaccaggagcgtgtgcagaggctcaaggaggagtgcgaggccggcagccgcgagctcaagcgctgcaaggaggagaactacgacctggccatgcgcctggcgcaccagagtgaggagaagggcgccgcgctcatgcggaaccgtgacctgcagctggagattgaccagctcaagcacagcctcatgaaggccgaggacgactgcaaggtggagcgcaagcacacgctgaagctcaggcacgccatggagcagcggcccagccaggagctgctgtgggagctgcagcaggagaaggccctgctccaggcccgggtgcaggagctggaggcctccgtccaggaggggaagctggacaggagcagcccctacatccaggtactggaggaggactggcggcaggcgctgcgggaccaccaggagcaggccaacaccatcttctccctgcgcaaggacctccgccagggcgaggcccgacgcctccggtgcatggaggagaaggagatgttcgagctgcagtgcctggcactacgtaaggactccaagatgtacaaggaccgcatcgaggccatcctgctgcagatggaggaggtcgccattgagcgggaccaggccatagccacgcgggaggagctgcacgcacagcacgcccggggcctgcaggagaaggacgcgctgcgcaagcaggtgcgggagctgggcgagaaggcggatgagctgcagctgcaggtgttccagtgtgaggcgcagctactggccgtggagggcaggctcaggcggcagcagctggagacgctcgtcctgagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgacgcaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgcaaaaaaaaaaaaaaaaaaaaaaaaaaaaaaaaaaaaaaa

SEQ ID NO: 2883 - DNA, 2243 bp, Homo sapiens
  misc_feature (39)..(39): n is a, c, g, t or u
cctcagcctgcaaaggatgtatgtatgcctatttctttngccatagcatttgtaaggagactgggacatataggtgagcaatggaacatatacaaagtaataatgtctctaagataaatatttacaattcacaaatgtacaaagaattttatagatgcatccataattcacattttgtgtcattatcaccattttctcctaaattacataaaacttattttatttattgacatgtgcttcatatttatcatttatcactgcctgctaattttcatcaggagcatcaatggctattcaatatcctatttatgtaccatagtttataaatgtattgacatttaagtgataatttattatggtttttgctattataacttattgaattgatgaaatgacatacttttattaactgatttttctaatattaatttctagttccatgaggcttccacttggatggtaaaaagggtagacagcattctacttatatgcataaattaatctaggagtgaattttatttatctgggaataatttttagatatggcaactctcattcatttgacaagaaaaatctaaagctcataaaccctgaatcctatatgcttactctcacaaaaatctctaaatgtcctgctgggatttatccacagtttagattagacctggaatacatatggtcatgcaacaatgatcttagaacaggactttaacttggctttaggaactgaggctgagagtaatagaattgattttttgtgtgtgtgtgaagctcctattataataatgagaatactttgattcactcagttaaagttttcccctgatttattgtgtacatacaatgaaggatcaagaaagagaaatttttaaatggaagcattagccagacaagtttgacctcacagttttactaggggatatatcacctagttttggatctatttctaacatcttaacattgtgaaaagagtcttgggaaactggttaaatcccaaagaatgctgcaataggaggttggcccttatgagttatttaatatcttgagctgcttcggaaaatgttgctgagcaggcattgaagagtatcgataaaatttattgagaatttgtttattatgattaacagaggtaaaagccagtatattactgattaatataggtaaaagccagttaagaaattgggaatgctttctcttctgctttcttctacgatgcacaaggcgtttcacatttatgcccctatgaaaattactaggctgtcctagtcattagatctttcagcagtttgtagttttagagcttctaagttgacttctgtcttttctattcatacaattacacattctgtgatgatatttttggctcttgatttacattgggtactttcacaacccactgctcatgaaatttgcttttgtactactggttgtttttgcataggcccctccaggccacgaccaggtgtttggattttataaacgggccgtttgcattgtgaactgagctacaacaggcaggcaggggcagcaagatggtgttgcagacccaggtcttcatttctctgttgctctggatctctggtgaggaattaaaaagtgccacagtcttttcagagtaatatctgtgtagaaataaaaaaaattaagatatagttggaaataatgactatttccaatatggatccaattatctgctgacttataatactactagaaagcaaatttaaatgacatatttcaattatatctgagacagcgtgtataagtttatgtataatcattgtccattactgactacaggtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcagtttattactgtcagcaatatgatactattcccactttcggcggagggaccaaggtggagatcaaacgtaagtgcactttcctaatactttttcttataaggttttaaatttggagcgtttttgtgtttgagatattagctcaggtcaattccaaagagtac

SEQ ID NO: 2884 - DNA, 374 bp, Homo sapiens
  misc_feature (91)..(91): n is a, c, g, t or u
  misc_feature (151)..(151): n is a, c, g, t or u
  misc_feature (155)..(155): n is a, c, g, t or u
  misc_feature (312)..(312): n is a, c, g, t or u
  misc_feature (319)..(319): n is a, c, g, t or u
caaaaagtttgtactaaacaatcacctgggaagggtggccgacttcccaatgcagattcctgggccccatccccaaattgggttattaggntctcctccagatagctcagcattccagctttggctgacaagcctcactcagctgactctntttnagttgcactattaaacgtcttccatgcaggctttatagggaaggacaaggcaaagaacaaagcagtcaacaataaggaaaccaagccctcacaggaaagaaagcctgattcaagaaaacaaagtttgaaacaaggcatatttatatttaaaaatggnattaagnttcttaaagtggcttccataatccttcccttaattattatgttaccatttatgat

SEQ ID NO: 2885 - DNA, 580 bp, Homo sapiens; identical to SEQ ID NO: 2813
  misc_feature (1)..(1): n is a, c, g, t or u

SEQ ID NO: 2886 - DNA, 836 bp, Homo sapiens
gatctcttgggatcctgaaagggggcaggaaaggctggggtcccagtccaccctaatggtatctgagtgtcctagggcttcagttttcccacctgtccaatgggaccctttctgtcctcaccctacaaggggcacaaagggatgacaccaaacctggcaggaacttttcacgcaatcaagggaaggaaaggcattcctggcagagggaacagcatgccaagcgtgagaaggctcagagtaaggaggttaagagcccaagtattggagcctacagttttgccccttccatgcagtgtgacagtgggcaagttcctttccctctctgggtctcagttctgtcccctgcaaaatggtcagagcttaccccttggctgtgcagggtcaactttctgactggtgagagggattctcatgcaggttaagcttctgctgctcctcctcacctgcaaagcttttctgccacttttgcctccttggaaaactcttatccatctctcaaaactccagctaccacatccttgcagccttccctcatatacccccactactactgtagccctgtccttccctccagccccactctggccctggggctggggaagtgtctgtgtccagctgtctcccctgacctcagggttccttgggggctgggctgaggcctcagtacagagggggctctggaagtgtttgttgactgaataaacggaattcagtgcgaaaacaaaaaaataggaaataaaagatctcggaaaatagcattttgttaaaaccttggggggtaaaaccccggggagttttaacggaaaaattccagggaacacaacttgggggccaaa

SEQ ID NO: 2887 - DNA, 742 bp, Homo sapiens
ttttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttgtttttggtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattactggggttaacgcttctgtgaggaccttctggctcttgagataccctaaatatttacagatacttagatatcttgaagatagaataggatatcgagattgtaccaaataggaatatcaggagtatggtacaaatgagcagatacctgttgaa

SEQ ID NO: 2888 - DNA, 440 bp, Homo sapiens
ttttttgggttttaaggagtttattgctaatctgtaaaacagaaagagacaggagataagcatgacaaaatatagggaagaaatgacttttgcctaaacttccaaattgtgtacaattgaagcctctgctttatagctcttagcacacctctcaaataagaaggcagtactgggaaggctctgaacctgtggcagaaccactgatagctgtggagctattccaaggagtctgggaatcagggggattatcaagatcattgttagaataaattaatcttactgtatatatagcagaagttttcaagcatatgtaaatgctactaataaccaaataattacaccttgtttttctttaaactgtaactctcaagtatgtctctacataattttttgatggtagtgtctgcatgctcaaaaagcttgaaaacactactggagaa

SEQ ID NO: 2889 - DNA, 524 bp, Homo sapiens
tgcttattgaaactgaagggatgttgggaaagacagactgggagctttctctaaattttaatacagcatcagtgcttcctataatgtccaggttaggagagaagcaaatggagctttactaaggaagagaaagtgatcaataccagtgagaaaggtgaaaaaaaaaaaaaacaaacaaaaacgaaaaaaaaacctaagcaaattcagtgagaaaagaaaaagcagaacttagagtccttacccttcaatttaaggaaggagagttattgcctagcagaatcttgaaataaaatttccttagaaagccccagaaagttttgtgtgtattgcaagtccaaaggataaggagaacttctatatgctttcttcttatttccactgggcaaagtactgctccatcaagactcagcccgccatgaggctttccaatcaactctcaaccaccacaacagttagggctttttcctctatgttgcaaagcactttctgcataactcagaatgcaaaatgtactcattcatttg

SEQ ID NO: 2890 - DNA, 575 bp, Homo sapiens
ttttttttttttttttttttttttttttttttttttttttttttttttttttttttttttttttttggacccaaaaaaaaaaaacttttaaggaagggggacccagttaaaaccccttccaaatgcggcccaaccctgccccacggaaaccggccatggcaacccctaaataaaaaggggtttttgaggcggccggcccccacccaaaggatgcccccaatttttttttgccaggggggaatgtccttggacacggggccccaaaattccccatgccgggggtttgtactttaaaagggcttcctaacctcctccgggtgttcctaagggccatgctggagctaaaacttgtaaaaaaaggcccaggcttcccccaggtccgagtaaattttcacagggggggggaaccaccccctggccttggggattttccgttgactccaaaacagtttggccacggccagaaccacatgggggtaatgctcacactttttaagggaatccacgctttggggcctcctgtggggccttgcctggaggaagatggcctcacaccaaaggataccggagttggg

SEQ ID NO: 2891 - DNA, 467 bp, Homo sapiens
  misc_feature (428)..(428): n is a, c, g, t or u
tgatgccaagcccccaggagggctttattttttcttttcaacatcctggaacgcggctttcctggccatttttgcccggatccccaagaccccggcgttggcacggcccataccgaaactatgcaagggttcgaaattatcctttccctcacggacaactcgagctttctccttattatactaccttccctaccggcatgaccggaccggtcacctggggggccacgcacatttctacaggaaaactggctcccttcttgggggccgagggcttcctgtggaaaaggatgagtttggagcggtactccctcagccggtgcacgttgatctggagggactccgcggacttgctcctgctcctgggatccacaaaaatgcgctaaggtccggcccaccttcttgggaatgccgcccaccctgagctcctncaggatgaatccgcggccgactcgcaccttcttgggtac

SEQ ID NO: 2892 - DNA, 473 bp, Homo sapiens
ttcatttaatggcacatgatgatgcacacaaaacttcaactctcagtctggaatcagcccacaggtctgcagctataaaaatcatctcgaaaacatgagatttcagagatccagttctcagtgttaccttgaagatgacaatttatgaagaaacaggtgattttaatccgaaattgccaggaaacaaattactcctcaaaagcccttggaaagtaataagatagctaggcagaaaaaaaaagattctgcaaaactaaacttaatgtgtattcatctagacctgaattaaaaataaaattccactataaaaagaatttttcaaaatgttaggcccaagaatatggccatattgttccatcttgaagaacccagttgattcagtttcattactggcctccccactcttctaagtaagtccctcactataaacatttacgaattccatctcagcattagtactaaacaatattcat

SEQ ID NO: 2893 - DNA, 546 bp, Homo sapiens
  misc_feature (280)..(280): n is a, c, g, t or u
  misc_feature (537)..(537): n is a, c, g, t or u
cggtagtcaactcagttacttttaatattaaatgtctttttatcctagtaaactactcccttgcttaatgggagaacttgcaaatgagatttaaaacattgtaatttttataaggtaacagaagctagatccctttcactgttcatctcaagctattgatcttgtcagtgttgtacagatctagaatgggttgtcagggataaggtcactgatctgatggtgattgttgacatctgctgactccacacaacaaccctaggggaccggtgctttgagcatncttattttcagatggtttgcccacttcatgcagttaacagctgttggtgttgggcttcaaatccaggtctttcggacatcaaatcccagcctcttaacaactcaccaagcagtgattactactccccaacataggggcagtatgtacaagtcatgttgaactaatacagtttctttctttgataggaatactaattttgttgaacaagaaaatatgtactggataagagtaaggcatttgacaaggcgtcctgtganatctgtgaa

SEQ ID NO: 2894 - DNA, 1993 bp, Homo sapiens
actcatttataccaggaaacagacaagagaacaagaggctgccgaagacaaaacttctctgcaagcacctgtgcacagcaatgtgcgtgggcatctgtgagaagaagagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtataaggagaacttagttagtacctccaaatcttggctgcatggaagtatctttggtgacatcaactcttctccaagtgaagacaactggttgaaggggaccaggaggttggacacagaccattgcaatggaaatgcagatgatttagactgttcttctctgactgatgactgggagtcagggaagatgaatgcagagtctgtgatcacctcctcttccagccacatcatatctcagcctcctggaggaaactcccatagcttgtctcttcagtcccagttgacagcttctgaacgtttccaagagaatagttcggatcattcagaaaccaggttgttgcaagaggtcttctttcaggcaatcctgcttgctgtgtgcttaatcacttctgcatgtgcaagatggtttatgggagaaatattagccagtgtcttcacatgctcattgatgataactgtagcttatgtgaaatcattgtttctcagccttgccagctatttcaaaaccactgcctgtgctcggtttgtcaaaatttgacaaccatttaggaatgccttcgatgaatgtcctccatctgaatatctggaaattgtccaacttgcagtctacttggaatcaagtgttttattggaagggagtaagcgagtaatggagaaaaagccattttagtttgactatgtgattttaaaatgatctcagtttttccatcaaaattataatatgctcatgaaaataatattaatttgccttccctttgcaaacaccggcagttgaaaggaaaaggacggggaatgtgatggaaaagagaccgcctggaataaatgtccccctatgattctttaaggcagtggttctcgagcttgaattttcattaggaaattctgtgaggagcttgtaaccagatttctgggtctgccacatgcacctatctcttgctgaattgctttaatagaataatgagagcaagtttgtctaactaataccaacctgacaacttgaataacaataaatgcaatttgtacataaaatataatgctgcaaaagtttgtcattcacctcagtggagtgacttgatattaggtggtaaccgtagatgatggttaatatgaaaatggacaggaaagaagcattttctgaaagttatattcttttgaaccacgttctaaaccaagtttttaatcttcttggggctcgtaattacctttcactttaatgtcacttaaagatataacacagaaaaatgccttgagggcaaaatataggcaaaacaccaatgcgctttcaaatgcatgaaaatggtgcagttgtacccttgagccttgactcaagggctgtagatgttccctttccaccccccacacttggtgcgtgttcacaaagcaaatatggcctgtaattcaaatttgttctatgtgatactctctgagtaaaaactcatacatgcagaaaattgtctttgctcgaaatgataatgccaaaatataactttatatataatttgcatttagtacatttttggttaaaaaataaactaataaataagtgaagtcatcagc

SEQ ID NO: 2895 - DNA, 521 bp, Homo sapiens
tgatgtttacttaagctttatttatatatatagtgcgtaggttcctggagcacaaagaagaaagttgctcagatttatccagacctcacataagtttatagatttcaagtagccactgtattttattacagaaaatacattcttcaagaggaaaatgttaaggccatagcagctttcaccttagctatctaagcttgtattaggtcatcattaaatagtatctgtatcattcttatgtgttccgtaagttatgccacaaataccagaccaagtacactcagtctagaaacaaaaaagtgggaaataaaggttaaaacattctaataggtgtaatgggctgatagatgactttatattacaaagctacttaagacaattctacttttctagaatacaacgcattaatataaacatttgaaattcagaagatttggcctgtggatgctttgtttctcaatgcaattcttgttaatatgttagtaagtaataatttattaataccaataataaaaaattaacat

SEQ ID NO: 2896 - DNA, 1679 bp, Homo sapiens; identical to SEQ ID NO: 428

SEQ ID NO: 2897 - DNA, 450 bp, Homo sapiens
ttttggcggggcaggggttggcgggggcagtcctttgaactaagattctctcaggaaccactgcaggaaatgaagtgattcagaactcaccaattatgaactaaccttcaatgccagaggctttaacagtttctaataaaaattcagttcagatctcaagttcagataagtctgaaaaaacacttcaaggtcatctgaacgaacatattctaccagtactttatataattgtatttacctgttcctaaaactttccgtgaaagaaatgttgaattttcttcagaaatagttttgagcaaaatgtcaaaacaattctcccatgctcagtgtacttttgactatactctgaaaatatttcttcttgttttcctgcacttacctgttagtgtgctcacactcctgtattatggaacatgttcagtaactcatacacatgtaacacagaagtct

SEQ ID NO: 2898 - DNA, 260 bp, Homo sapiens
ggcatgactagaggtgtgactaataataatccctcacatctctatagcctaatacagttttccaagggttttctcatccatgatctcatttgatccttgcagcagtcctatgaggaaggcagcacatacatcattagctcccttttgccaaagaggaaacaaaaaacaggtgaaagggacttgtctaagggcacccagctctaagggacagagcaaagtaacaggtcatttctttttttcatttatttttagagacagag

SEQ ID NO: 2899 - DNA, 452 bp, Homo sapiens
tttttttttttttttttttttttttttttttttttttttttttggaaattggaaagggcaaattaattaagttttttaaagccatcaagttacaaagggctattaggggtcttaaaaagacaaagagtatccaataaaacaaaaagcaattccagatggttttaggtggaacaattttgggccagttatatctataggccattcctaatttacttagcaaactttatcccggggattggcaaattaaaaaaaaggaagaaccaacctatattttcttttcggttttttggaaacagagcctccactctgtcatccaggctggagtacaggggggggatctcagctcaacataccctcaacctttggggttcaaggaatctcgggcctaaccctcccaagcagttgggactacaggcatgcaccaccgggctcggccaattttttgcattttt

SEQ ID NO: 2900 - DNA, 511 bp, Homo sapiens
  misc_feature (500)..(500): n is a, c, g, t or u
ttttttttagtgttttaggttttaatgtcaagattaagcatcaaacaattgtaaaataaagatgttttaacagagtggacaggtaataaacacgttcaacaaaggcagatgttcttggaggttaaatcccactaatcaacacgattaactttaagggtcctgagactttcaatagcatgtacctcatggactaaaaaagaggaagagtttatgcttcacaattaatctccagaacttgacacatgtaattcttatcaccaaggctttagattgaaaagtaatagaaaacaacagtaactgttctggtacagtctagcatttccaatgtgcttctttttattttaatgaaaaaaaaagatacattatatcaaacaaaactgttgatggatccacatctttgcaggctctttgcggaatggctcaccaaatacacatttccatctttagatcattatactgcttaaacagcaagatatgctaaagagatatgaatatgattntgacctaccat

SEQ ID NO: 2901 - DNA, 541 bp, Homo sapiens
tttttttttttttttttcctgacgtatacagatcatcctggacagtttatttctctaattctgttaatcaaagcagagatcagaacggattaactgtggcaacgtcgtatcaggagcacaaagagaagcctgcctctttcagtttggtcttttctccagcaaaacagaaatgcaatttagtcaaacacatacagaggccccactgtactgcctcactgatggagggaaatacttgggtgcaatcacacacagtgttagtgattggcaactgtccagtgctatttcgctaaaactggtaaaaacagtttccttgggcaagcagctgattggctacttcatactgtgctgagttgggctcagcttgtctgtctctgggaggccctaaggggctcctctttttcagctagggataaggggagactgtcaaccagtatcttagcgtgaactgtcaatcgctgagcccctgccaaggactctctggaagtccctcaggtatgctgaaaataccttatactgaaaaggtagctctcgctgcatccac

SEQ ID NO: 2902 - DNA, 646 bp, Homo sapiens
gaattaaaaataatacttttattgctggttatgctttcttaaaagtaaaaattattcttgattgatgtgacttgccagaatgtttgaaacaccagtgaccaagggtcactatatctgcccccaaacaattccaccatgtttacttatatagcactcaccaaaccagaagagaggctgggatattctcaggccactgcactgaacatcaatatgaaagaaccatgaatgatgcgacaactgagttgattttctacctcctctgcccaccatgactttgcaccccaaattctttcagtgtcttttcaaggtacaaccctccttctgggcacaggttggctgggtcacctcaaggtatgttccttcattctgcagtgatttcctgcctctgctcaattaaggaagttgagaatacagataactcaggatcatgtttaattatgtaaaaaagctctaaagtcaggtaatggttttcatgtgcttctcttgagcagtctgaggagagaatagaaacagaaaccccttggggcctgagtagacgcagctggccatgcacaggcagaggctcttggtcagtgcaggaagcagagtcacagccatcgccttggggtggggatgaaatgagatgacctgttggctgtatgacagc

SEQ ID NO: 2903 - DNA, 557 bp, Homo sapiens
atctcaaaggcaattgagtgggtcttctgggccagacctatttaatttacgaaacatagtaccttgcagagaataggcattgaaatattatttaaacaatcaaaccaaagatgttcttctatcttcagctgtcagtgatctaatgccctcatctctcttatcctcaggacccagaatggtatattccacataaaagatgctttgtttatcaaatgaatcaaaaagcacgcctgaggcatttatttttactcctttacttctgtaggccaggtcaaggtgggtctaattcacttttatcatcagcacttaagaaactggatggaagaccacaacaccttgttttttgcaaaaattttccatctcctcaatcaggccaggaagcatgtatcttctggacaggactttatctctctactcagcttagtacactgccttatattagtccatttgtcccatgttttcatcactgaataaacttgttaaatgacttttggtctggatctcacacctatattacttcatttccttctgtgagcactctataatgataacatcat

SEQ ID NO: 2904 - DNA, 488 bp, Homo sapiens
  misc_feature (239)..(239): n is a, c, g, t or u
gcggccgcggaaactttgcaggcccgcggcatcgagcacggcgggcctagggcgggtgtgtgcgcgtgggtcgcgaggtgacaggagccggccctcgtccttaatggagcggccagagctgggtgggggcggcccgggagctcggggttcccggcactacctgaatgcagcccgaagccaagttgtgcacgcgtttgtcctataaaagcgaagtgagtggattcccattttggaatccncggtgtctccaacctcgagttggagaaccatgttgagtcagttccccggaaccttacaaatggactccacttcccccgttcccattctaccgttttttttaaaaaatgatttttttgagtggcggttccaggattagtcaaatagcttctcccgagaatgctctttaaaagattgtcagacacctttgggttaagtctcagtttttgcatgggcccgaattgcagtcctatgaatttctgatttattca

SEQ ID NO: 2905 - DNA, 696 bp, Homo sapiens; identical to SEQ ID NO: 436

SEQ ID NO: 2906 - DNA, 347 bp, Homo sapiens
tttttaagtcacccagtttgtggtactttattacagcagctcaaggagaattacaaagtggatggattgagtacaagttccttcatcgtaagtggaagcagaagttcctaactcttttagtatttgtcatctgaactacttttctatcttttacctcctccaatagataagttattagaaggcaaatattgcttcttgattttttgttttccgtctatctaagcttgaattttatgtgcacgtaaggtagatgtgaaattcatgggcatcaaatatgggtgggtaaaatataattttgttttctataattaaaattattctatatctagatccttgttgcattgggg

SEQ ID NO: 2907 - DNA, 549 bp, Homo sapiens
ttttttgttttcccttgactttatttatcttcataagtcacaaaatgtgagtgcagagataaatgtctgtgtgcatgtgccctgagcacacagggtggcataactcggcacactcataatgacacagccgttcacccagccacagatagtgacagggcacacatggcgacacccacatgtacggagataaatctcccccaccatgacatgggtagacagaaaacacgccgcagtatactctagtatgtttacacaaacagggagacaggcccgtgcaatgcatgtcaccaacacccacactcagagtgacatctgctggaggtgctcagacacagccacccaccgtgacatgccgagactcacatatgtcacatgacacaggcatgcatgccacattcactgtgactctcagtcctattcattcatcacctttctgggagatacactgaaatgtccaccctttgcaaaatgcacacacacgcgcacgcacacacgcacacacacgaacacacgcgcacacacgcacacacacgcacgcaggtgtacaca

SEQ ID NO: 2908 - DNA, 400 bp, Homo sapiens
ctttcttttctcttctttcttcacgcaggtacaaaggacagagtatatttcttcactcaggttcagaggacagaataatgaatcttctttctttccttctttcttccttccttccttctttccttccttccttcccttttcctatggacagctgagaatcattttctaactttatcaaatatgctccctcctcttaagatagcctgccctggctgcttcctatgtctcttgcagtctgaccaggcactgtagggaagaggcccaaatgcacccacctggcccagatatccagaggccaaggccacggtcctgcaccacagcgtgagagttcttctttgcagtgcctacaaacctatgcttgcccccaaactcgctcaggggtaacggggttggggaaaga

SEQ ID NO: 2909 - DNA, 547 bp, Homo sapiens
ttttttttttttttggttttgaacctttaataaaagtaaaaaatgaatgcaaaaagaacacaatgttgaaaacttagtatgaatgtgaacctcactagatgttcaaatctggtagagtgcaaattttgttcatactattttacatttttacaaactcaaatcactttggttcatatattttctataaactattggcaaaaaaatcctcaaatttacattcttttggctacattatttctaacagatatagatttacttccggtttcggagagaaagacttattgtgtgtgcgtgatcaagtctgttttaaagattcactcgctgctttcatctaataacttctggtttttcataaaatgctgacatcttcattggaaatttttttcatgtaactgttttcattttcagaaaatatataagggggtcattccaaagttcagaatgatcctatttttttaaaaaacaaaattcctgtaaaacaaattaactccaggaacttaaaatttactccaagacatttccctcaaaacaaagcaaaaaaccccag

SEQ ID NO: 2910 - DNA, 549 bp, Homo sapiens
attttggaaaatgttaaaatttattaataatagttaacatcacatagttaattaaactagttatgtattgtacataatgacaacatcttcactagactgagtgctcaaggatttgagatgattcgctattcatcacaccccgaagattgagatccactgtatttacacaaagcaaagccatgtcagcaagggactgtcaacctgattctgagaacataaacattcaaaatttattttccagtgttcctttttggaaaccaacaacacatctttaatacctacacacacacacatctctacctttaaaaaaaaaaaaaaagtgtaacttcacagatagtacctaatcttcaagcttaaaatttaagttaaaattaatctctattttgtgggcaccctttagtgaactaaaatctacatgaaaccttttggcttttgtgtagcaggaaatacccacgttttgggtcaattagtgcagatgggagcagcagaggagctacaccagacagcaaagcaagactagagcaaacgagaaggaccagcccctagccc

SEQ ID NO: 2911 - DNA, 408 bp, Homo sapiens
tttttgcaatgtagttttgttggaggccattttttattgcagacttgaagagctattacgttcgcggcgtggcgcccggtggtccccaaggggagggaagggggaggcggggcgaggacagtgaccggagtctcctcagcggtggcttttctgcttggcagcctcagcggctggcgccaaaaccggactccgcccacttcctcgcccctgcggtgcgagggtgtggaatcctccagacgctgggggagggggagttgggagcttaaaaactagtacccctttgggaccactttcagcagcgaactctcctgtacaccaggggtcagttccacagacgcgggccaggggtgggtcattgcggcgtgaacaataatttgactagaagttgattcgggtgtttccggaagg

SEQ ID NO: 2912 - DNA, 525 bp, Homo sapiens
taatctcaaaggcaattgagtgggtcttctgggccagacctatttaatttacgaaacatagtaccttgcagagaataggcattgaaatattatttaaacaatcaaaccaaagatgttcttctatcttcagctgtcagtgatctaatgccctcatctctcttatcctcaggacccagaatggtatattccacataaaagatgctttgtttatcaaatgaatcaaaaagcacgcctgaggcatttatttttactcctttacttctgtaggccaggtcaaggtgggtctaattcacttttatcatcagcacttaagaaactggatggaagaccacaacaccttgttttttgcaaaaattttccatctcctcaatcaggccaggaagcatgtatcttctggacaggactttatctctctactcagcttagtacactgccttatattagtccatttgtcccatgttttcatcactgaataaacttgttaaatgacttttggtctggatctcacacctatattacttcatt

SEQ ID NO: 2913 - DNA, 1085 bp, Homo sapiens
ttatggatccagaatgtatattcattcagcatattaaagatatgtgctttgacattcatttgaattggagattcaagcctattgttatcttatgaacacttcagcaaacaggtctgccattcttaaaaatataatgctttgttggacaaaagggacaagccacgtcccctggtcctctcctctattcgcctgtgaactccatccacacgtaaaggacctctgggtctgactgtcccctccacaggcatggtgctgggaaaaggaaacaggcatatctggcttttcagattttaaaccggaaactctcacagtcacaaatccaccatgagacttgggagattggatgagctgtctcccaaaccctaacaccttccaccttctcaaaatgaaggctgccctttcactgggaggttctgaatgcgggattggtgctgactcaggctgggcacaaaggagaacaggaggacatggaaaatccgacaattcgaagtacaaatatttcaaacacatgtgaaaaccatttggaaagaagaaaagaggtatctggaatgatttcatgacagaaatgaaaaaagataaatttagttctaatcttcctggcaacaaagccccagaggagaaggtttcattgtctgaagataaaaacacacccgtttgcctggatatgaacacagtattcctgcaccaaattctagaaagaatatactttcttctaacaaagccaagagtttttcttgtactcattacagggggcttttaatcctaacatattttttaactccttatgaaaatgcataaaagttaaaaagatatttcacgatagaatcaagcctatgaaatcgtcaaatctattaactccttaacgaaccgaattaaggaccaaaaacaaaccttgttttttcacaaaggttggatgttgtaaacgtccgaaagtgtccttttatacgaaagacagtaatctggggaaatatttactggaatgacacaggtctttgggggaaggaactatttaccggataaatgggaaaagaaatgttagcgagactatggtataacacgggctaggagataacaaataaatatta

SEQ ID NO: 2914 - DNA, 2610 bp, Homo sapiens
ccgctggttccgtaacaacatcccgttggcttccctcaggcggcgggaccagtgcagccgccgcctcccaggatcgtccgccggtcagggcccttgccctccccggcacaggccaccatggccaccaacccacagccgcagccgcctcctccggcgccgccgcctcccccgccgcagccgcagccgcagccaccgccgccgccgccgggccccggggctggccccggcgcgggcggggcgggcggcgcgggtgcgggcgccggggacccgcagctcgtggccatgatcgtgaaccacctcaagagccaggggctcttcgaccagttccgcagagactgcctggccgacgtggacaccaagcctgcgtatcagaatctgagacagcgtgttgacaactttgttgcaaatcacttggcaactcacacatggagtccgcatctcaataagaaccagctaagaaacaacattagacaacaagtcctcaaatcaggaatgttggagtctggtattgaccgaattatttctcaggttgtggacccaaagatcaaccacacattcagacctcaggtagagaaagctgtgcatgagtttttggccacgctaaatcacaaagaggaaggaagtggcaacacagctcccgatgatgagaaaccagacacttcccttattacacaaggtgttcctactcctgggcccagtgctaatgtagccaatgatgccatgtcgatattggaaaccataacttctcttaaccaagaagccagtgctgctagggcttcaacagaaacatcaaatgccaagaccagtgagagagcgtcaaaaaaacttccatctcagccaaccactgatactagtactgacaaagaaagaacttcagaggacatggctgataaagaaaaatctacagctgactctggaggtgaaggactggaaacagccccaaagtctgaagagttcagcgacctcccctgtccagtcgaagaaattaaaaattacacaaaagagcataataatttaattctgctaaataaggatgttcaacaggaaagcagtgagcaaaaaaataaatcaacagacaaaggtgaaaagaagccagacagcaatgagaaaggagaaagaaagaaagaaaagaaggaaaagactgaaaagaaatttgatcactcaaaaaagagtgaagatacacagaaagttaaagatgaaaaacaagcaaaggaaaaagaagtagagagtttaaaacttccttcagaaaagaacagtaataaagctaaaactgttgaagggacaaaagaagatttctctttgatagattctgatgtggatggacttacagacatcacagttagctctgttcataccagtgacctttcatcttttgaagaagatactgaggaggaagttgtaacgtctgatagcatggaagaaggagagattacgtcagatgatgaagagaagaacaaacagaataaaacaaaaactcaaactagtgattctagtgaaggaaaaacaaaaagtgtacggcatgcgtatgtccacaaaccatatctttactcaaaatactatagtgattctgatgatgagcttactgtagaacaacgacgacagtccattggtattttgtggttttaggccaaagaaaaagaagagaggcttttaagaaggcaaatcaatagagaaaaacttgaagaaaaacgaaaacagaaagcagaaaagacaaagtcttcaaaaaccaagggtcaaggcaggagtagtgtggacttagaagaatcatcaacaaagagtttggaacctaaagccgccagaattaaagaagtccttaaagaacggaaagttttagaaaaaaaagtagccttaagcaaaaagagaaaaaaagattcaaggaatgttgaagagaactccaaaaagaaacagcaatatgaagaagattccaaagaaacccttaaaacaagtgagcattgtgaaaaggaaaaaatttcttcttcaaaggagctgaagcatgttcatgcaaaaagtgaaccaagtaaacctgcccggagactttcagagtctttgcatgtagttgacgaaaacaaaaatgaatccaaattagaaagagaacataaaagacggacatctacccctgttatcatggagggggtacaggaagagactgacacaagagatgtaaaaaggcaagtagaacgctcagaaatttgcaccgaagagccccagaaacagaaaagcacacttaaaaacgaaaagcatctaaagaaagatgattctgaaacaccacatttgaaaagcctacttaagaaagaggtgaaatcctccaaggagaagcctgaaagagagaaaactccatcggaagacaaattgtctgtgaaacataaatataaaggtgattgtatgcataaaacaggtgatgagactgagcttcactcttctgagaaaggtttaaaagtagaggaaaatattcaaaagcaaagtcaacaaacaaagctttcttcagatgataaaaccgaacgaaaaagtaaacataggaatgaaaggaaattatcagtattaggcaaagatggaaagccagtttctgaatatattataaaaacagatgagaatgttcgtaaagaaaaaaaa

SEQ ID NO: 2915 - DNA, 279 bp, Homo sapiens
  misc_feature (86)..(118): n is a, c, g, t or u
gcaggtactagcttcaactctctaaataaatttcaaggctttgtgaaaataacctctcttctcattcaagggtatgtttactggtnnnnnnnnnnnnnnnnnnnnnnnnnnnnnnnnnactgtaaaaggatagtgtttgcatctagaggactagagacatgcctgcacatccctcaccttcaaaggtgaactctacacaggattcttgtcctagtcattgtggcaaccccatctgacaccttgtgtagtacctcggccgcgaccacgctaatcactagt

SEQ ID NO: 2916 - DNA, 1082 bp, Homo sapiens
gatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgccgtaaaaaaaaaaaaaaaaaaaaaaaaaaaaa

SEQ ID NO: 2917 - DNA, 610 bp, Homo sapiens
  misc_feature (7)..(8): n is a, c, g, t or u
  misc_feature (605)..(605): n is a, c, g, t or u
  misc_feature (608)..(608): n is a, c, g, t or u
aattctnnaactcaaataaaagcagggaaatatgtcagctaattaaaaaaaaacggcaacttgaacaatacttgtctctcagtaaatagtaaagaccatcacaaaataaaaggtattcttatttgttattatttaatagaagacacattctctggtccatttatatcctgtatacaaattaacttattttgattgtatccatgcaatctaagacaataaaaatagaagaaaaaacagccacataaacagcaaagtgttattactgatttaattgaattgatttgacattttcagtccactgatatatttcctgagataaaagttgcccttagtattcatgaatctgtagttcattcttagtaattttaacatgaaaaattgatgtgtttaaattttcactttaatattcatgttttctataaaatattgtaaaattctaagatattatggttatacatatttattactattattacatattaatgtgaattttgagaaactttcctttgcatgattttctcaaattacaaaatatattattctcttataaaggacagcaagtttaaaatggagcaaggagcattggaaatatatttaaagggaangangg

SEQ ID NO: 2918 - DNA, 1679 bp, Homo sapiens; identical to SEQ ID NO: 428

SEQ ID NO: 2919 - DNA, 2232 bp, Homo sapiens
cttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcaacaacaagcttcaaggaattc

SEQ ID NO: 2920 - DNA, 1620 bp, Homo sapiens
caaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaggacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatcttcgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacctccgttttgatgagaatgctgtggtccgcaacacccagatcgacaactcctgggggtctgaggagcgaagtctgccccgaaaaatgcccttcgtccgtggccagagcttctcagtgtggatcttgtgtggagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcaaaaaaaaaaaaaaaaaaaaa

SEQ ID NO: 2921 - DNA, 916 bp, Homo sapiens
acttctcgctcgacacagccagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcacccctaccagttcccaagtccatgtgtaccccgctcaccacgggaacggccccccccaaccacaggcatcaggcaaccatttgaaataaaactccttcagcctgtgaaaaaaaaaa

SEQ ID NO: 2922 - DNA, 1272 bp, Homo sapiens
gaattcggccaaagaggcctatgcttctctgaagacttgcagcaaggcttgctgaggctcacagaagatagccccagtgttttggagtggttttgaatgtgattctgagatcagactgactgagctggaatcctggctttatatcttaccagctacacaaccttggagtcttagaaattttttcttttcaataagcagtcatccttactttccctcaagatgacaaacagttcgttcttctgcccagtttataaagatctggagccattcacgtattttttttatttagttttccttgttggaattattggaagttgttttgcaacctgggcttttatacagaagaatacgaatcacaggtgtgtgagcatctacttaattaatttgcttacagccgatttcctgcttactctggcattaccagtgaaaattgttgttgacttgggtgtggcaccttggaagctgaagatattccactgccaagtaacagcctgcctcatctatatcaatatgtatttatcaattatcttcttagcatttgtcagcattgaccgctgtcttcagctgacacacagctgcaagatctaccgaatacaagaacccggatttgccaaaatgatatcaaccgttgtgtggctaatggtccttcttataatggtgccaaatatgatgattcccatcaaagacatcaaggaaaagtcaaatgtgggttgtatggagtttaaaaaggaatttggaagaaattggcatttgctgacaaatttcatatgtgtagcaatatttttaaatttctcagccatcattttaatatccaattgccttgtaattcgacagctctacagaaacaaagataatgaaaattacccaaatgtgaaaaaggctctcatcaacatacttttagtgaccacgggctacatcatatgctttgttccttaccacattgtccgaatcccgtataccctcagccagacagaagtcataactgattgctcaaccaggatttcactcttcaaagccaaagaggctacactgctcctggctgtgtcgaacctgtgctttgatcctatcctgtactatcacctctcaaaagcattccgctcaaaggtcactgagacttttgcctcacctaaagagaccaaggctcagaaagaaaaattaagatgtgaaaataatgcataaaagacaggattttttgtgctaccaattctggccttactggaccataaagttaattatagctttgaaagataaaaaaaaaaaaaaagcggccgc

SEQ ID NO: 2923 - DNA, 413 bp, Homo sapiens
tttttttttttttttgtagagggtcacatcaatccataggaaaggaaacctgcttcttctcacaaagggataacttttgttttcctcatgagtcaacttgaaggataactttaaaaaattggtccatgcagcagagtgagactccgtctcaaaaaaaaaaaaaaaaaaaaaaaaaggtccatgcagaagactatctttttccaatttgtataagggaactatgtaagttcactgtagctctgggtatcctcaacccacagatctggcaggcagcttgcagcccatcttcagaggagggccaagtgtccattcagactcgggtatttccacactagctgtctttgagttccatcaagtagatagagaacttctgatccaagggattttatagagattacaaccccctcgtgccg

SEQ ID NO: 2924 - DNA, 474 bp, Homo sapiens
tttttttttttgcttcaattcctttctatacaaccgtggttctcaaccaggggtccttctggtccccaggggatgctaggtggtgtctgggggcatttgtgactgttatgactcagggatgctcctggcgtggagtgggtggaggccagggatgctgatcagaaccttgcagtggccaggacaaccccaccccagagaacgacccagccctgaatgccaagggggagagactctgccttaattatttggaaaaatattgtatctgctccctgttgacaccagacactagaaaaaattcccgatggggtggatggcagaaaccaaggggggccccagctcctgcgattctcctcctctctccctccccactcagggtgtggattacaatgtgtgcagcctcctggaacctcaggaggacagaggatcatgagacacagagtttcttggggatctgtggaatcccctaacccccgg

SEQ ID NO: 2925 - protein, 199 aa, Homo sapiens; identical to SEQ ID NO: 2487

SEQ ID NO: 2926 - protein, 326 aa, Homo sapiens
MDYSHQTSLVPCGQDKYISKNELLLHLKTYNLYYEGQNLQLRHREEEDEFIVEGLLNISWGLRRPIRLQMQDDNERIRPPPSSSSWHSGCNLGAQGTTLKPLTVPKVQISEVDAPPEGDQMPSSTDSRGLKPLQEDTPQLMRTRSDVGVRRRGNVRTPSDQRRIRRHRFSINGHFYNHKTSVFTPAYGSVTNVRINSTMTTPQVLKLLLNKFKIENSAEEFALYVVHTSGEKQKLKATDYPLIARILQGPCEQISKVFLMEKDQVEEVTYDVAQYIKFEMPVLKSFIQKLQEEEDREVKKLMRKYTVLRLMIRQRLEEIAETPATI

SEQ ID NO: 2927 - protein, 364 aa, Homo sapiens
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGLVHGAIGGAGVTALLALCLCLIFFIVKTHRRKAARTAVGSNDTHPTTGSASPKHQKNSKLHGPTETSSCSGAAPTVEMDEELHYASLNFHGMNPSKDTSTEYSEVRTQ

SEQ ID NO: 2928 - protein, 326 aa, Homo sapiens; identical to SEQ ID NO: 2926

SEQ ID NO: 2929 - protein, 1842 aa, Homo sapiens
LPHGRTRGPGPAMAPWRKADKERHGVAIYNFQGSGAPQLSLQIGDVVRIQETCGDWYRGYLIKHKMLQGIFPKSFIHIKEVTVEKRRNTENIIPAEIPLAQEVTTTLWEWGSIWKQLYVASKKERFLQVQSMMYDLMEWRSQLLSGTLPKDELKELKQKVTSKIDYGNKILELDLIVRDEDGNILDPDNTSVISLFHAHEEATDKITERIKEEMSKDQPDYAMYSRISSSPTHSLYVFVRNFVCRIGEDAELFMSLYDPNKQTVISENYLVRWGSRGFPKEIEMLNNLKVVFTDLGNKDLNRDKIYLICQIVRVGKMDLKDTGAKKCTQGLRRPFGVAVMDITDIIKGKAESDEEKQHFIPFHPVTAENDFLHSLLGKVIASKGDSGGQGLWVTMKMLVGDIIQIRKDYPHLVDRTTVVARKLGFPEIIMPGDVRNDIYITLLQGDFDKYNKTTQRNVEVIMCVCAEDGKTLPNAICVGAGDKPMNEYRSVVYYQVKQPRWMETVKVAVPIEDMQRIHLRFMFRHRSSLESKDKGEKNFAMSYVKLMKEDGTTLHDGFHDLVVLKGDSKKMEDASAYLTLPSYRHHVENKGATLSRSSSSVGGLSVSSRDVFSISTLVCSTKLTQNVGLLGLLKWRMKPQLLQENLEKLKIVDGEEVVKFLQDTLDALFNIMMEHSQSDEYDILVFDALIYIIGLIADRKFQHFNTVLEAYIQQHFSATLAYKKLMTVLKTYLDTSSRGEQCEPILRTLKALEYVFKFIVRSRTLFSQLYEGKEQMEFEESMRRLFESINNLMKSQYKTTILLQVAALKYIPSVLHDVEMVFDAKLLSQLLYEFYTCIPPVKLQKQKVQSMNEIVQSNLFKKQECRDILLPVITKELKELLEQKDDMQHQVLERKYCVELLNSILEVLSYQDAAFTYHHIQEIMVQLLRTVNRTVITMGRDHILISHFVACMTAILNQMGDQHYSFYIETFQTSSELVDFLMETFIMFKDLIGKNVYPGDWMAMSMVQNRVFLRAINKFAETMNQKFLEHTNFEFQLWNNYFHLAVAFITQDSLQLEQFSHAKYNKILNKYGDMRRLIGFSIRDMWYKLGQNKICFIPGMVGPILEMTLIPEAELRKATIPIFFDMMLCEYQRSGDFKKFENEIILKLDHEVEGGRGDEQYMQLLESILMECAAEHPTIAKSVENFVNLVKGLLEKLLDYRGVMTDESKDNRMSCTVNLLNFYKDNNREEMYIRYLYKLRDLHLDCDNYTEAAYTLLLHTWLLKWSDEQCASQVMQTGQQHPQTHRQLKETLYETIIGYFDKGKMWEEAISLCKELAEQYEMEIFDYELLSQNLIQQAKFYESIMKILRPKPDYFAVGYYGQGFPSFLRNKVFIYRGKEYERREDFQMQLMTQFPNAEKMNTTSAPGDDVKNAPGQYIQCFTVQPVLDEHPRFKNKPVPDQIINFYKSNYVQRFHYSRPVRRGTVDPENEFASMWIERTSFVTAYKLPGILRWFEVVHMSQTTISPLENAIETMSTANEKILMMINQYQSDETLPINPLSMLLNGIVDPAVMGGFAKYEKAFFTEEYVRDHPEDQDKLTHLKDLIAWQIPFLGAGIKIHEKRVSDNLRPFHDRMEECFKNLKMKVEKEYGVREMPDFDDRRVGRPRSMLRSYRQMSIISLASMNSDCSTPSKPTSESFDLELASPKTPRVEQEEPISPGSTLPEVKLRRSKKRTKRSSVVFADEKAAAESDLKRLSRKHEFMSDTNLSEHAAIPLKASVLSQMSFASQSMPTIPALALSVAGIPGLDEANTSPRLSQTFLQLSDGDKKTLTRKKVNQFFKTMLASKSAEEGKQIPDSLSTDL

SEQ ID NO: 2930 - protein, 386 aa, Homo sapiens
MEELDALLEELERSTLQDSDEYSNPAPLPLDQHSRKETNLDETSEILSIQDNTSPLPAQLVYTTNIQELNVYSEAQEPKESPPPSKTSAAAQLDELMAHLTEMQAKVAVRADAGKKHLPDKQDHKASLDSMLGGLEQELQDLGIATVPKGHCASCQKPIAGKVIHALGQSWHPEHFVCTHCKEEIGSSPFFERSGLAYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 2931 - protein, 368 aa, Homo sapiens; identical to SEQ ID NO: 2505

SEQ ID NO: 2932 - protein, 359 aa, Homo sapiens
MAEAITYADLRFVKAPLKKSISSRLGQDPGADDDGEITYENVQVPAVLGVPSSLASSVLGDKAAVKSEQPTASWRAVTSPAVGRILPCRTTCLRYLLLGLLLTCLLLGVTAICLGVRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 2933 - protein, 266 aa, Homo sapiens
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVNRQRDQVKRYYSVVYPGWPIYPRNRYTSLFLIVNSVILILSVIITILVQLKYPNLVLLD

SEQ ID NO: 2934 - protein, 1429 aa, Homo sapiens; identical to SEQ ID NO: 2621

SEQ ID NO: 2935 - protein, 352 aa, Homo sapiens; identical to SEQ ID NO: 2486

SEQ ID NO: 2936 - protein, 248 aa, Homo sapiens
MLSTVGSFLQDLQNEDKGIKTAAIFTADGNMISASTLMDILLMNDFKLVINKIAYDVQCPKREKPSNEHTAEMEHMKSLVHRLFTILHLEESQKKREHHLLEKIDHLKEQLQPLEQVKAGIEAHSEAKTSGLLWAGLALLSIQGGALAWLTWWVYSWDIMEPVTYFITFANSMVFFAYFIVTRQDYTYSAVKSRQFLQFFHKKSKQQHFDVQQYNKLKEDLAKAKESLKQARHSLCLQMQVEELNEKN

SEQ ID NO: 2937 - protein, 790 aa, Homo sapiens
MAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFCTLCFIEYRENKHFAAASGKVSPTASRFQNTIPCLGRECGTLGSTMFEGYCQKCFIEAQNQRFHEAKRTEEQLRSSQRRDVPRTTQSTSRPKCARASCKNILACRSEELCMECQHPNQRMGPGAHRGEPAPEDPPKQRCRAPACDHFGNAKCNGYCNECFQFKQMYG

SEQ ID NO: 2938 - protein, 206 aa, Homo sapiens
MALPCTLGLGMLLALPGALGSGGSAEDSVGSSSVTVVLLLLLLLLLATGLALAWRRLSRDSGGYYHPARLGAALWGRTRRLLWASPPGRWLQARAELGSTDNDLERQEDEQDTDYDHVADGGLQADPGEGEQQCGEASSPEQVPVRAEEARDSDTEGDLVLGSPGPASAGGSAEALLSDLHAFAGSAAWDDSARAAGGQGLHVTAL

SEQ ID NO: 2939 - protein, 718 aa, Homo sapiens
MIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 2940 - protein, 247 aa, Homo sapiens; identical to SEQ ID NO: 2472

SEQ ID NO: 2941 - protein, 191 aa, Homo sapiens
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHV

SEQ ID NO: 2942 - protein, 441 aa, Homo sapiens
MEIRLDTLSASLGRSSTLNDCNLEDKLAWYEGEAYMWHHWKPFPENPLWTCLDFQIAQVGPWDYCSSCIRHTRLKSSCSDMDLLHSWRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 2943 - protein, 564 aa, Homo sapiens
MKEHGGTFSSTGISGGSGDSAMDSLQPLQPNYMPVCLFAEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 2944 - protein, 91 aa, Homo sapiens; identical to SEQ ID NO: 2488

SEQ ID NO: 2945 - protein, 461 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 2946 - protein, 823 aa, Homo sapiens
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 2947 - protein, 441 aa, Homo sapiens
MVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKDSIDREKIAVIGHSFGGATVIQTLSEDQRFRCGIALDAWMFPLGDEVYSRIPQPLFFINSEYFQYPANIIKMKKCYSPDKERKMITIRGSVHQNFADFTFATGKIIGHMLKLKGDIDSNVAIDLSNKASLAFLQKHLGLHKDFDQWDCLIEGDDENLIPGTNINTTNQHIMLQNSSGIEKYN

SEQ ID NO: 2948 - protein, 1044 aa, Homo sapiens
MPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLIGKGLHEFDSLCDPEVNDFRAKMCQFCEEAAARRQQLGWEAWLQYSFPLQLEPSAQTWGPGTLRLPNRALLVNVKFEGSEESFTFQVSTKDVPLALMACALRKKATVFRQPLVEQPEDYTLQVNGRHEYLYGNYPLCQFQYICSCLHSGLTPHLTMVHSSSILAMRDEQSNPAPQVQKPRAKPPPIPAKKPSSVSLWSLEQPFRIELIQGSKVNADERMKLVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKILELGRHSECVHVTEEEQLQLREILERRGSGELYEHEKDLVWKLRHEVQEHFPEALARLLLVTKWNKHEDVAQMLYLLCSWPELPVLSALELLDFSFPDCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYSNEEAGSGGSVGIIFKNGDDLRQDMLTLQMIQLMDVLWKQEGLDLRMTPYGCLPTGDRTGLIEVVLRSDTIANIQLNKSNMAATAAFNKDALLNWLKSKNPGEALDRAIEEFTLSCAGYCVATYVLGIGDRHSDNIMIRESGQLFHIDFGHFLGNFKTKFGINRERVPFILTYDFVHVIQQGKTNNSEKFERFRGYCERAYTILRRHGLLFLHLFALMRAAGLPELSCSKDIQYLKDSLALGKTEEEALKHFRVKFNEALRESWKTKVNWLAHNVSKDNRQ

SEQ ID NO: 2949 - protein, 167 aa, Homo sapiens
MEHIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 2950 - protein, 263 aa, Homo sapiens
MVKIAFNTPTAVQKEEARQDVEALLSRTVRTQILTGKELRVATQEKEGSSGRCMLTLLGLSFILAGLIVGGACIYKYFMPKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKNLVELFGKLASGRYLPQTYVVREDLVAVEEIRDVSNLGIFIYQLCNNRKSFRLRRRDLLLGFNKRAIDKCWKIRHFPNEFIVETKICQE

SEQ ID NO: 2951 - protein, 201 aa, Homo sapiens
MDPGWPCCPLPVAFLSRWLQSFVDGLFCTGGLLRQRTCKFAGAASQAPHAPAFLRARGEPQDPLSHPRVPAVSANCRMWKHLPVHSSPTPRLTPLWKLQARWLLPQLVYLQGWGSYSLLRPAALISMVLLAREFLYPAKMSVSEVCSSGLSSPLLEQHKTNLIFYASGDICSANGKSGFNQPLPFLKTFCSTHRILSCTYL

SEQ ID NO: 2952 - protein, 492 aa, Homo sapiens
MSDYENDDECWSVLEGFRVTLTSVIDPSRITPYLRQCKVLNPDDEEQVLSDPNLVIRKRKVGVLLDILQRTGHKGYVAFLESLELYYPQLYKKVTGKEPARVFSMIIDASGESGLTQLLMTEVMKLQKKVQDLTALLSSKDDFIKELRVKDSLLRKHQERVQRLKEECEAGSRELKRCKEENYDLAMRLAHQSEEKGAALMRNRDLQLEIDQLKHSLMKAEDDCKVERKHTLKLRHAMEQRPSQELLWELQQEKALLQARVQELEASVQEGKLDRSSPYIQVLEEDWRQALRDHQEQANTIFSLRKDLRQGEARRLRCMEEKEMFELQCLALRKDSKMYKDRIEAILLQMEEVAIERDQAIATREELHAQHARGLQEKDALRKQVRELGEKADELQLQVFQCEAQLLAVEGRLRRQQLETLVLSSDLEDGSPRRSQELSLPQDLEDTQLSDKGCLAGGGSPKQPFAALHQEQVLRNPHDAGPAGLPGIGAVC

SEQ ID NO: 2953 - protein, 92 aa, Homo sapiens; identical to SEQ ID NO: 2494

SEQ ID NO: 2954 - protein, 266 aa, Homo sapiens; identical to SEQ ID NO: 2502

SEQ ID NO: 2955 - protein, 359 aa, Homo sapiens; identical to SEQ ID NO: 2932

SEQ ID NO: 2956 - protein, 643 aa, Homo sapiens
MQAPRELAVGIDLGTTYSCVGVFQQGRVEILANDQGNRTTPSYVAFTDTERLVGDAAKSQAALNPHNTVFDAKRLIGRKFADTTVQSDMKHWPFRVVSEGGKPKVPVSYRGEDKTFYPEEISSMVLSKMKETAEAYLGQPVKHAVITVPAYFNDSQRQATKDAGAIAGLNVLRIINEPTAAAIAYGLDRRGAGERNVLIFDLGGGTFDVSVLSIDAGVFEVKATAGDTHLGGEDFDNRLVNHFMEEFRRKHGKDLSGNKRALGRLRTACERAKRTLSSSTQATLEIDSLFEGVDFYTSITRARFEELCSDLFRSTLEPVEKALRDAKLDKAQIHDVVLVGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDANGILSVTATDRSTGKANKITITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCGTQARQGDPSTGPIIEEVD

SEQ ID NO: 2957 - protein, 565 aa, Homo sapiens
MAEGKAGGAAGLFAKQVQKKFSRAQEKVLQKLGKAVETKDERFEQSANNFYQQQAEGHKLYKDLKNFLSAVKVMHESSKRVSETLQEIYSSEWDGHEELKAIVWNNDLLWEDYEEKLADQAVRTMEIYVAQFSEIKERIAKRGRKLVDYDSARHHLEAVQNAKKKDEAKTAKAEEEFNKAQTVFEDLNQELLEELPILYNSRIGCYVTIFQNISNLRDVFYREMSKLNHNLYEVMSKLEKQHSNKVFVVKGLSSSSRRSLVISPPVRTATVSSPLTSPTSPSTLSLKSESESVSATEDLAPDAAQGEDNSEIKELLEEEEIEKEGSEASSSEEDEPLPACNGPAQAQPSPTTERAKSQEEVLPSSTTPSPGGALSPSGQPSSSATEVVLRTRTASEGSEQPKKRASIQRTSAPPSRPPPPRATASPRPSSGNIPSSPTASGGGSPTSPRASLGTGTASPRTSLEVSPNPEPPEKPVRTPEAKENENIHNQNPEELCTSPTLMTSQVASEPGEAKKMEDKEKDNKLISADSSEGQDQLQVSMVPENNNLTAPEPQEEVSTSENPQL

SEQ ID NO: 2958 - protein, 349 aa, Homo sapiens; identical to SEQ ID NO: 2541

SEQ ID NO: 2959 - protein, 620 aa, Homo sapiens
MNNFILLEEQLIKKSQQKRRTSPSNFKVRFFVLTKASLAYFEDRHGKKRTLKGSIELSRIKCVEIVKSDISIPCHYKYPFQVVHDNYLLYVFAPDRESRQRWVLALKEETRNNNSLVPKYHPNFWMDGKWRCCSQLEKLATGCAQYDPTKNASKKPLPPTPEDNRRPLWEPEETVVIALYDYQTNDPQELALRRNEEYCLLDSSEIHWWRVQDRNGHEGYVPSSYLVEKSPNNLETYEWYNKSISRDKAEKLLLDTGKEGAFMVRDSRTAGTYTVSVFTKAVVSENNPCIKHYHIKETNDNPKRYYVAEKYVFDSIPLLINYHQHNGGGLVTRLRYPVCFGRQKAPVTAGLRYGKWVIDPSELTFVQEIGSGQFGLVHLGYWLNKDKVAIKTIREGAMSEEDFIEEAEVMMKLSHPKLVQLYGVCLEQAPICLVFEFMEHGCLSDYLRTQRGLFAAETLLGMCLDVCEGMAYLEEACVIHRDLAARNCLVGENQVIKVSDFGMTRFVLDDQYTSSTGTKFPVKWASPEVFSFSRYSSKSDVWSFGVLMWEVFSEGKIPYENRSNSEVVEDISTGFRLYKPRLASTHVYQIMNHCWKERPEDRPAFSRLLRQLAEIAESGL

SEQ ID NO: 2960 - protein, 262 aa, Homo sapiens
MDPRLSTVRQTCCCFNVRIATTALAIYHVIMSVLLFIEHSVEVAHGKASCKLSQMGYLRIADLISSFLLITMLFIISLSLLIGVVKNREKYLLPFLSLQIMDYLLCLLTLLGSYIELPAYLKLASRSRASSSKFPLMTLQLLDFCLSILTLCSSYMEVPTYLNFKSMNHMNYLPSQEDMPHNQFIKMMIIFSIAFITVLIFKVYMFKCVWRCYRLIKCMNSVEEKRNSKMLQKVVLPSYEEALSLPSKTPEGGPAPPPYSEV

SEQ ID NO: 2961 - protein, 467 aa, Homo sapiens
MQMDNRLPPKKVPGFCSFRYGLSFLVHCCNVIITAQRACLNLTMVVMVNSTDPHGLPNTSTKKLLDNIKNPMYNWSPDIQGIILSSTSYGVIIIQVPVGYFSGIYSTKKMIGFALCLSSVLSLLIPPAAGIGVAWVVVCRAVQGAAQGIVATAQFEIYVKWAPPLERGRLTSMSTSGFLLGPFIVLLVTGVICESLGWPMVFYIFGACGCAVCLLWFVLFYDDPKDHPCISISEKEYITSSLVQQVSSSRQSLPIKAILKSLPVWAISIGSFTFFWSHNIMTLYTPMFINSMLHVNIKENGFLSSLPYLFAWICGNLAGQLSDFFLTRNILSVIAVRKLFTAAGFLLPAIFGVCLPYLSSTFYSIVIFLILAGATGSFCLGGVFINGLDIAPRYFGFIKACSTLTGMIGGLIASTLTGLILKQDPESAWFKTFILMAAINVTGLIFYLIVATAEIQDWAKEKQHTRL

SEQ ID NO: 2962 - protein, 444 aa, Homo sapiens
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 2963 - protein, 272 aa, Homo sapiens
RCKPISGHNSLFWYRQTMMRGLELLIYFNNNVPIDDSGMPEDRFSAKMPNASFSTLKIQPSEPRDSAVYFCASSFSTCSANYGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 2964 - protein, 276 aa, Homo sapiens
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMYKENLVSTSKSWLHGSIFGDINSSPSEDNWLKGTRRLDTDHCNGNADDLDCSSLTDDWESGKMNAESVITSSSSHIISQPPGGNSHSLSLQSQLTASERFQENSSDHSETRLLQEVFFQAILLAVCLITSACARWFMGEILASVFTCSLMITVAYVKSLFLSLASYFKTTACARFVKI

SEQ ID NO: 2965 - protein, 133 aa, Homo sapiens
MVLQTQVFISLLLWISGAYGDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYDTIPTFGGGTKVEIKR

SEQ ID NO: 2966 - protein, 369 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 2967 - protein, 323 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERRTHMPFQKGMPFDLCFLVQSSDFKVMVNGILFVQYFHRVPFHRVDTIFVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNLRFDENAVVRNTQIDNSWGSEERSLPRKMPFVRGQSFSVWILCGAHCLKVAVDGQHLFEYYHRLRNLPTINRLEVGGDIQLTHVQT

SEQ ID NO: 2968 - protein, 1866 aa, Homo sapiens
MDPVGLQLGNKNLWSCLVRLLTKDPEWLNAKMKFFLPNTDLDSRNETLDPEQRVILQLNKLHVQGSDTWQSFIHCVCMQLEVPLDLEVLLLSTFGYDDGFTSQLGAEGKSQPESQLHHGLKRPHQSCGSSPRRKQCKKQQLELAKKYLQLLRTSAQQRYRSQIPGSGQPHAFHQVYVPPILRRATASLDTPEGAIMGDVKVEDGADVSISDLFNTRVNKGPRVTVLLGKAGMGKTTLAHRLCQKWAEGHLNCFQALFLFEFRQLNLITRFLTPSELLFDLYLSPESDHDTVFQYLEKNADQVLLIFDGLDEALQPMGPDGPGPVLTLFSHLCNGTLLPGCRVMATSRPGKLPACLPAEAAMVHMLGFDGPRVEEYVNHFFSAQPSREGALVELQTNGRLRSLCAVPALCQVACLCLHHLLPDHAPGQSVALLPNMTQLYMQMVLALSPPGHLPTSSLLDLGEVALRGLETGKVIFYAKDIAPPLIAFGATHSLLTSFCVCTGPGHQQTGYAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQARERTIIFLLSPPTETTAELQRAPDLQESDGQRKGAQSRSLTLRLQKCQLQVHDAEALIALLQEGPHLEEVDLSGNQLEDEGCRLMAEAASQLHIARKLDLSDNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGRFTGCSLSQEHVESLCWLLSKCKDLSQVDLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRVQEPWADRARVLSLLEVCAQASGSVTEISISETQQQLCVQLEFPRQEENPEAVALRLAHCDLGAHHSLLVGQLMETCARLQQLSLSQVNLCEDDDASSLLLQSLLLSLSELKTFRLTSSCVSTEGLAHLASGLGHCHHLEELDLSNNQFDEEGTKALMRALEGKWMLKRLDLSHLLLNSSTLALLTHRLSQMTCLQSLRLNRNSIGDVGCCHLSEALRAATSLEELDLSHNQIGDAGVQHLATILPGLPELRKIDLSGNSISSAGGVQLAESLVLCRRLEELMLGCNALGDPTALGLAQELPQHLRVLHLPFSHLGPGGALSLAQALDGSPHLEEISLAENNLAGGVLRFCMELPLLRQIDLVSCKIDNQTAKLLTSSFTSCPALEVILLSWNLLGDEAAAELAQVLPKMGRLKRVDLEKNQITALGAWLLAEGLAQGSSIQVIRLWNNPIPCDMAQHLKSQEPRLDFAFFDNQPQAPWGT

SEQ ID NO: 2969 - protein, 547 aa, Homo sapiens
MATMVPSVLWPRACWTLLVCCLLTPGVQGQEFLLRVEPQNPVLSAGGSLFVNCSTDCPSSEKIALETSLSKELVASGMGWAAFNLSNVTGNSRILCSVYCNGSQITGSSNITVYGLPERVELAPLPPWQPVGQNFTLRCQVEGGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSHFVPVFVAVLLTLGVVTIVLALMYVFREHQRSGSYHVREESTYLPLTSMQPTEAMGEEPSRAE

SEQ ID NO: 2970 - protein, 260 aa, Homo sapiens; identical to SEQ ID NO: 2438

SEQ ID NO: 2971 - protein, 495 aa, Homo sapiens
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSRLSAYPALEGVLHRSSMQPDNSSDSDYDLHGAQRL

SEQ ID NO: 2972 - protein, 130 aa, Homo sapiens
KVFERCELARTLKRLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCQNRDVRQYVQGCGV

SEQ ID NO: 2973 - protein, 491 aa, Homo sapiens [sequence omitted]

SEQ ID NO: 2974 - protein, 862 aa, Homo sapiens
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPETDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 2975 - protein, 1256 aa, Homo sapiens
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 2976 - protein, 319 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKSST

SEQ ID NO: 2977 - protein, 240 aa, Homo sapiens
MLLQSQTMGVSHSFTPKGITIPQREKPGHMYQNEDYLQNGLPTETTVLGTVQILCCLLISSLGAILVFAPYPSHFNPAISTTLMSGYPFLGALCFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 2978 - protein, 266 aa, Homo sapiens
MVCLKLPGGSSLAALTVTLMVLSSRLAFAGDTRPRFLELRKSECHFFNGTERVRYLDRYFHNQEEFLRFDSDVGEYRAVTELGRPVAESWNSQKDLLEQKRGRVDNYCRHNYGVGESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSALTVEWRARSESAQSKMLSGVGGFVLGLLFLGAGLFIYFRNQKGHSGLQPTGFLS

SEQ ID NO: 2979 - protein, 325 aa, Homo sapiens
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALSPCAVSSTLPDWHIPVEVVPDSTSDLYNFQVSPMPSTSEATTDEDEEGKLPEDIMKLLEQSEWQPTNVDGKGYLLNEPGVQPTSVYGDFSCKEEPEIDSPGGDIGLSLQRVFTDLKNMDATWLDSLLTPVRLPSIQAIPCAP

SEQ ID NO: 2980 - protein, 132 aa, Homo sapiens; identical to SEQ ID NO: 2406

SEQ ID NO: 2981 - protein, 319 aa, Homo sapiens
MTNSSFFCPVYKDLEPFTYFFYLVFLVGIIGSCFATWAFIQKNTNHRCVSIYLINLLTADFLLTLALPVKIVVDLGVAPWKLKIFHCQVTACLIYINMYLSIIFLAFVSIDRCLQLTHSCKIYRIQEPGFAKMISTVVWLMVLLIMVPNMMIPIKDIKEKSNVGCMEFKKEFGRNWHLLTNFICVAIFLNFSAIILISNCLVIRQLYRNKDNENYPNVKKALINILLVTTGYIICFVPYHIVRIPYTLSQTEVITDCSTRISLFKAKEATLLLAVSNLCFDPILYYHLSKAFRSKVTETFASPKETKAQKEKLRCENNA

SEQ ID NO: 2982 - protein, 334 aa, Homo sapiens
MLTKPLQGPPAPPGTPTPPPGGKDREAFEAEYRLGPLLGKGGFGTVFAGHRLTDRLQVAIKVIPRNRVLGWSPLSDSVTCPLEVALLWKVGAGGGHPGVIRLLDWFETQEGFMLVLERPLPAQDLFDYITEKGPLGEGPSRCFFGQVVAAIQHCHSRGVVHRDIKDENILIDLRRGCAKLIDFGSGALLHDEPYTDFDGTRVYSPPEWISRHQYHALPATVWSLGILLYDMVCGDIPFERDQEILEAELHFPAHVSPDCCALIRRCLAPKPSSRPSLEEILLDPWMQTPAEDVTPQPLQRRPCPFGLVLATLSLAWPGLAPNGQKSHPMAMSQG

SEQ ID NO: 2983 - protein, 158 aa, Homo sapiens
MMQKLLKCSRLVLALALILVLESSVQGYPTQRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 2984 - protein, 1019 aa, Homo sapiens
ADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 2985 - protein, 783 aa, Homo sapiens
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGLGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDGAGNLDEEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGIEEEDADDGFPAPPKQLDMGDEVYDDVDTSDFPVSSAEMSQGTNFGKAKTEEKDLKKLKKQEKEEKDFRKKFKYDGEIRVLYSTKVTTSITSKKWGTRDLQVKPGESLEVIQTTDDTKVLCRNEEGKYGYVLRSYLADNDGEIYDDIADGCIYDND

SEQ ID NO: 2986 - protein, 266 aa, Homo sapiens; identical to SEQ ID NO: 2978

SEQ ID NO: 2987 - protein, 363 aa, Homo sapiens
MEVKKKKHDKQEQKGSVGATFKLGDSLSNPNERAIVKEKMVSNTKSVDTKASSSKFSRILTPKEYLQRQKHKEAPSNKASKKICVKNVPCDSEHMRPSKLAVQVESCGKSNEKHSSGVQTSKESLNGLTSHGKNLKIHHSQESKTYNILRNVKEKVGGKQPDKIWIDKTKLDKLTNISNEAQFSQMPPQVKDQKKLYLNRVGFKCTERESISLTKLESSPRKLHKDKRQENKHKTFLPVKGNTEKSNMLEFKLCPDILLKNTNSVEERKDVKPHPRKEQAPLQVSGIKSTKEDWLKFVATKKRTQKDSQERDNVNSRLSKRSFSADGFEMLQNPVKDSKEMFQTYKQMYLEKRSRSLGSSPVK

SEQ ID NO: 2988 - protein, 836 aa, Homo sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 2989 - protein, 276 aa, Homo sapiens
MGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVNHYSEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 2990 - protein, 359 aa, Homo sapiens
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDR

SEQ ID NO: 2991 - protein, 505 aa, Homo sapiens
MGSMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 2992 - protein, 1333 aa, Homo sapiens
MTADKLVFFVNGRKVVEKNADPETTLLAYLRRKLGLSGTKLGCGEGGCGACTVMLSKYDRLQNKIVHFSANACLAPICSLHHVAVTTVEGIGSTKTRLHPVQERIAKSHGSQCGFCTPGIVMSMYTLLRNQPEPTMEEIENAFQGNLCRCTGYRPILQGFRTFARDGGCCGGDGNNPNCCMNQKKDHSVSHSPSLFKPEEFTPLDPTQEPIFPPELLRLKDTPRKQLRFERERVTWIQASTLKELLDLKAQHPDAKLVVGNTEIGIEMKFKNMLFPMIVCPAWIPELNSVEHGPDGISFGAACPLSIVEKTLVDAVAKLPAQKTEVFRGVLEQLRWFAGKQVKSVASVGGNIITASPISDLNPVFMASGAKLTLVSRGTRRTVQMDHTFFPGYRKTLLSPEEILLSIEIPYSREGEYFSAFKQASRREDDIAKVTSGMRVLFKPGTTEVQELALCYGGMANRTISALKTTQRQLSKLWKEELLQDVCAGLAEELHLPPDAPGGMVDFRCTLTLSFFFKFYLTVLQKLGQENLEDKCGKLDPTFASATLLFQKDPPADVQLFQEVPKGQSEEDMVGRPLPHLAADMQASGEAVYCDDIPRYENELSLRLVTSTRAHAKIKSIDTSEAKKVPGFVCFISADDVPGSNITGICNDETVFAKDKVTCVGHIIGAVVADTPEHTQRAAQGVKITYEELPAIITIEDAIKNNSFYGPELKIEKGDLKKGFSEADNVVSGEIYIGGQEHFYLETHCTIAVPKGEAGEMELFVSTQNTMKTQSFVAKMLGVPANRIVVRVKRMGGGFGGKETRSTVVSTAVALAAYKTGRPVRCMLDRDEDMLITGGRHPFLARYKVGFMKTGTVVALEVDHFSNVGNTQDLSQSIMERALFHMDNCYKIPNIRGTGRLCKTNLPSNTAFRGFGGPQGMLIAECWMSEVAVTCGMPAEEVRRKNLYKEGDLTHFNQKLEGFTLPRCWEECLASSQYHARKSEVDKFNKENCWKKRGLCIIPTKFGISFTVPFLNQAGALLHVYTDGSVLLTHGGTEMGQGLHTKMVQVASRALKIPTSKIYISETSTNTVPNTSPTAASVSADLNGQAVYAACQTILKRLEPYKKKNPSGSWEDWVTAAYMDTVSLSATGFYRTPNLGYSFETNSGNRFHYFSYGVACSEVEIDCLTGDHKNLRTDIVMDVGSSLNPAIDIGQVEGAFVQGLGLFTLEELHYSPEGSLHTRGPSTYKIPAFGSIPIEFRVSLLRDCPNKKAIYASKAVGEPPLFLAASIFFAIKDAIRAARAQHTGNNVKELFRLDSPATPEKIRNACVDKFTTLCVTGVPENCKPWSVRV

SEQ ID NO: 2993 - protein, 415 aa, Homo sapiens
MEGKAIATSLGGDRVLIFPCSPRSSFVFTSRLSSLPLKRASIGGAVSCSGVNGLTRWNSIVSTRRLVPVRSINSESDSDSDFPHENQQGNPGLGKFKEYQEWDSWTAKFSGGANIPFLMLQLPQIILNTQNLLAGNNTALSAVPWLGMLTGLLGNLSLLSYFAKKREKEAAVVQTLGVVSTHIVLAQLTMAEAMPIQYFVATSAVVTIGLIVNCLYYFGKLSKTVWQLWEDVITIGGLSVLPQIMWSTFVPLVPNSILPGTTAFGIAVAAIIMARTGKLSEKGVRFVGSLSGWTATLMFMWMPVSQMWTNFLNPDNIKGLSSITMLLSMMGNGLMIPRALFIRDLMWLTGSLWATLFYGYGNILCLYLVNCTSQSFFVAATIGLISWIGLALWRDAVAYGHNSPFRSLKELVFGP

SEQ ID NO: 2994 - protein, 363 aa, Homo sapiens; identical to SEQ ID NO: 2458

SEQ ID NO: 2995 - protein, 691 aa, Homo sapiens
MMRNHRIASSLCGDQVFSKKKKKKKKNNMAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 2996 - protein, 390 aa, Homo sapiens
MASPAIGQRPYPLLLDPEPPRYLQSLSGPELPPPPPDRSSRLCVPAPLSTAPGAREGRSARRAARGNLEPPPRASRPARPLRPGLQQRLRRRPGAPRPRDVRSIFEQPQDPRVPAERGEGHCFAELVLPGGPGWCDLCGREVLRQALRCTNCKFTCHPECRSLIQLDCSQQEGLSRDRPSPESTLTVTFSQNVCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQVLFQKLSIADRPLYLRLLAGPDTEVLSFVLKENETGEVEWDAFSIPELQNFLSSWCIQIYLYY

SEQ ID NO: 2997 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 2998 - protein, 261 aa, Homo sapiens
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNDQEETAGVVSTPLIRNGDWTFQILVMLEMTPQRGDVYTCHVEHPSLQSPITVEWRAQSESAQSKMLSGIGGFVLGLIFLGLGLIIHHRSQKGLLH

SEQ ID NO: 2999 - protein, 258 aa, Homo sapiens
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 3000 - protein, 175 aa, Homo sapiens
MTDCEFGYIYRLAQDYLQCVLQIPQPGSGPSKTSRVLQNVAFSVQKEVEKNLKSCLDNVNVVSVDTARTLFNQVMEKEFEDGIINWGRIVTIFAFEGILIKKLLRQQIAPDVDTYKEISYFVAEFIMNNTGEWIRQNGGWENGFVKKFEPKSGWMTFLEVTGKICEMLSLLKQYC

SEQ ID NO: 3001 - protein, 825 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 3002 - protein, 285 aa, Homo sapiens; identical to SEQ ID NO: 2470

SEQ ID NO: 3003 - protein, 444 aa, Homo sapiens
MAVTTRLTRLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPTNFQIDGRNRKVIMDLKTMENLGLAQNCTISIQDYEVFRCEDSLDERKIKGVIELRKSLLSALRTYEPYGSLVQQIRILLLGPIGAGKSSFFNSVRSVFQGHVTHQALVGTNTTGISEKYRTYSIRDGKDGKYLPFILCDSLGLSEKEGGLCRDDIFYILNGNIRDRYQFNPMESIKLNHHDYIDSPSLKDRIHCVAFVFDASSIQYFSSQMIVKIKRIRRELVNAGVVHVALLTHVDSMDLITKGDLIEIERCEPVRSKLEEVQRKLGFALSDISVVSNYSSEWELDPVKDVLILSALRRMLWAADDFLEDLPFEQIGNLREEIINCAQGKK

SEQ ID NO: 3004 - protein, 432 aa, Homo sapiens
MGPAGSLLGSGQMQITLWGSLAAVAIFFVITFLIFPCSSCDREKKPRQHSGDHENLMNVPSDKEMFSRSVTSLATDAPASSEQNGALTNGDILSEDSTLTCMQHYEEVQTSASDLLDSQDSTGKPKCHQSRELPRIPPESAVDTMLTARSVDGDQGLGMEGPYEVLKDSSSQENMVEDCLYETVKEIKEVAAAAHLEKGHSGKAKSTSASKELPGPQTEGKAEFAEYASVDRNKKCRQSVNVESILGNSCDPEEEAPPPVPVKLLDENENLQEKEGGEAEESATDTTSETNKRFSSLSYKSREEDPTLTEEEISAMYSSVNKPGQLVNKSGQSLTVPESTYTSIQGDPQRSPSSCNDLYATVKDFEKTPNSTLPPAGRPSEEPEPDYEAIQTLNREEEKATLGTNGHHGLVPKENDYESISDLQQGRDITRL

SEQ ID NO: 3005 - protein, 501 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKYNLFAPEIQFDFPKDSELVTFDTPFGKFGIFTCFDIFSHDPAAVVVDEVSIDSILYPTAWYNTLPLLSAVPFHSAWAKAMGVNLLAANTHNTSMHMTGSGIYAPEAVKVYHYDMETESGQLLLSELKSRPRREPTYPAAVDWHAYASSVKPFSSEQSDFLGMIYFDEFTFTKLKRNTGNYTACQKDLCCHLTYKMSEKRTDEIYALGAFDGLHTVEGQYYLQICALLKCQTTDLETCGEPVGSAFTKFEDFSLSGTFGTRYVFPQIILSGSQLAPERHYEISRDGRLRSRSGAPLPVLVMALYGRVFEKDPPRLGQGSGKFQ

SEQ ID NO: 3006 - protein, 329 aa, Homo sapiens
MWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 3007 - protein, 1170 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKWKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLYPQFQGRLVANLTYTLQLDGHRTRRRGLFPGGRHELRRNIAVTTSMSCTDFSFHFPVCVQDLISPINVSLNFSLWEEEGTPRDQRAQGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 3008 - protein, 502 aa, Homo sapiens
MATNPQPQPPPPAPPPPPPQPQPQPPPPPPGPGAGPGAGGAGGAGAGAGDPQLVAMIVNHLKSQGLFDQFRRDCLADVDTKPAYQNLRQRVDNFVANHLATHTWSPHLNKNQLRNNIRQQVLKSGMLESGIDRIISQVVDPKINHTFRPQVEKAVHEFLATLNHKEEGSGNTAPDDEKPDTSLITQGVPTPGPSANVANDAMSILETITSLNQEASAARASTETSNAKTSERASKKLPSQPTTDTSTDKERTSEDMADKEKSTADSGGEGLETAPKSEEFSDLPCPVEEIKNYTKEHNNLILLNKDVQQESSEQKNKSTDKGEKKPDSNEKGERKKEKKEKTEKKFDHSKKSEDTQKVKDEKQAKEKEVESLKLPSEKNSNKAKTVEGTKEDFSLIDSDVDGLTDITVSSVHTSDLSSFEEDTEEEVVTSDSMEEGEITSDDEEKNKQNKTKTQTSDSSEGKTKSVRHAYVHKPYLYSKYYSDSDDELTVEQRRQSIGILWF

SEQ ID NO: 3009 - protein, 61 aa, Homo sapiens
MKRFLFLLLTISLLVMVQIQTGLSGQNDTSQTSSPSASSSMSGGIFLFFVANAIIHLFCFS

SEQ ID NO: 3010 - protein, 352 aa, Homo sapiens; identical to SEQ ID NO: 2486

SEQ ID NO: 3011 - protein, 94 aa, Homo sapiens
MAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 3012 - protein, 748 aa, Homo sapiens
MSQWNQVQQLEIKFLEQVDQFYDDNFPMEIRHLLAQWIENQDWEAASNNETMATILLQNLLIQLDEQLGRVSKEKNLLLIHNLKRIRKVLQGKFHGNPMHVAVVISNCLREERRILAAANMPVQGPLEKSLQSSSVSERQRNVEHKVAAIKNSVQMTEQDTKYLEDLQDEFDYRYKTIQTMDQSDKNSAMVNQEVLTLQEMLNSLDFKRKEALSKMTQIIHETDLLMNTMLIEELQDWKRRQQIACIGGPLHNGLDQLQNCFTLLAESLFQLRRQLEKLEEQSTKMTYEGDPIPMQRTHMLERVTFLIYNLFKNSFVVERQPCMPTHPQRPLVLKTLIQFTVKLRLLIKLPELNYQVKVKASIDKNVSTLSNRRFVLCGTNVKAMSIEESSNGSLSVEFRHLQPKEMKSSAGGKGNEGCHMVTEELHSITFETQICLYGLTIDLETSSLPVVMISNVSQLPNAWASIIWYNVSTNDSQNLVFFNNPPPATLSQLLEVMSWQFSSYVGRGLNSDQLHMLAEKLTVQSSYSDGHLTWAKFCKEHLPGKSFTFWTWLEAILDLIKKHILPLWIDGYVMGFVSKEKERLLLKDKMPGTFLLRFSESHLGGITFTWVDHSESGEVRFHSVEPYNKGRLSALPFADILRDYKVIMAENIPENPLKYLYPDIPKDKAFGKHYSSQPCEVSRPTERGDKGYVPSVFIPISTIRSDSTEPHSPSDLLPMSPSVYAVLRENLSPTTIETAMKSPYSAE

SEQ ID NO: 3013 - protein, 92 aa, Homo sapiens; identical to SEQ ID NO: 2494

SEQ ID NO: 3014 - protein, 444 aa, Homo sapiens; identical to SEQ ID NO: 2962

SEQ ID NO: 3015 - protein, 769 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 3016 - DNA, 50 bp, Homo sapiens
gggaggaacactgcactcttaagcttccgccgtctcaacccctcacagga

SEQ ID NO: 3017 - DNA, 50 bp, Homo sapiens
aggagtcttttacccggtgtgctttgccgcagtcatccaaaataaattca

SEQ ID NO: 3018 - DNA, 50 bp, Homo sapiens
cacctgattccccctcttgcccacaggactctgctgttgttttcattctg

SEQ ID NO: 3019 - DNA, 50 bp, Homo sapiens
attatatttgtccctatcagaatcctcgaatccctagcagccagtccctg

SEQ ID NO: 3020 - DNA, 50 bp, Homo sapiens
gtcccttaggggagggagagttgtcctctttgcccacagtctaccctcag

SEQ ID NO: 3021 - DNA, 50 bp, Homo sapiens
cttgggccagactgtcagggttcaaggagggcatcaggagcagacggaga

SEQ ID NO: 3022 - DNA, 50 bp, Homo sapiens
ctcttcaaggggtctacatggcaactgtgaggaggggagattcagtgtgg

SEQ ID NO: 3023 - DNA, 50 bp, Homo sapiens
taagcataaaacctgacacgttaaaatccctgccctttggtgagcccact

SEQ ID NO: 3024 - DNA, 50 bp, Homo sapiens
tgctggtattctcactgccacatttttggaaacctgtattacaccttaaa

SEQ ID NO: 3025 - DNA, 50 bp, Homo sapiens
cagtcactgggtctatattaaacagcaaccagagcaacaaatggcaaaca

SEQ ID NO: 3026 - DNA, 50 bp, Homo sapiens
tctagcccagcattgatctagaagcagaggaatcccagcgccttttaaaa

SEQ ID NO: 3027 - DNA, 50 bp, Homo sapiens
tgggcaagacatgattaatgaatcagaatcctgtttcattggtgacttgg

SEQ ID NO: 3028 - DNA, 50 bp, Homo sapiens
tgcagattcctagtagcatgccttacctacagcactatgtgcatttgctg

SEQ ID NO: 3029 - DNA, 50 bp, Homo sapiens
ggtctgagagtctgtgaagatggcccagtcttctatcccccacctaaaaa

SEQ ID NO: 3030 - DNA, 50 bp, Homo sapiens
cttgaccaaacccacagcctgtctcttctcttgtttagttacttacggca

SEQ ID NO: 3031 - DNA, 50 bp, Homo sapiens
ccactgtcactgtttctctgctgttgcaaatacatggataacacatttga

SEQ ID NO: 3032 - DNA, 50 bp, Homo sapiens
tgcagccactattgttagtctcttgattcataatgacttaagcacacttg

SEQ ID NO: 3033 - DNA, 50 bp, Homo sapiens
cctgatggagagaagaaggcatatgttcgactggctcctgattacgatgc

SEQ ID NO: 3034 - DNA, 50 bp, Homo sapiens
gccgaattgtctttggtgcttttcacttgtgttttaaaataaggattttt

SEQ ID NO: 3035 - DNA, 50 bp, Homo sapiens
ctggaggacctgttgatgctagttcagagtatcaccaagagctggagagg

SEQ ID NO: 3036 - DNA, 50 bp, Homo sapiens
accatccaatcggacaagctttcagaaccttattgaaggatttgaagcac

SEQ ID NO: 3037 - DNA, 50 bp, Homo sapiens
agaaatgttcagtaatgaaaaaatatatccaatcagagccatcccgaaaa

SEQ ID NO: 3038 - DNA, 50 bp, Homo sapiens
agcggactcaggctccagctgtggctacaacatagggtttttatacaaga

SEQ ID NO: 3039 - DNA, 50 bp, Homo sapiens
accagactgacaaatgtgtatcggatgcttttgttcagggctgtgatcgg

SEQ ID NO: 3040 - DNA, 50 bp, Homo sapiens; identical to SEQ ID NO: 3031

SEQ ID NO: 3041 - DNA, 50 bp, Homo sapiens
aagtgaacaaaataagcaactaaatgagacctaataattggccttcgatt

SEQ ID NO: 3042 - DNA, 50 bp, Homo sapiens
tctgttgatagctggagaactttagtttcaagtactacattgtgaaagca

SEQ ID NO: 3043 - DNA, 50 bp, Homo sapiens
gacctcatctccaagatggagaagatctgacctccacggagccgctgtcc

SEQ ID NO: 3044 - DNA, 50 bp, Homo sapiens
ctgaccgccactctcacatttgggctcttcgctggccttggtggagctgg

SEQ ID NO: 3045 - DNA, 50 bp, Homo sapiens
atacagccccggcagaaaacgcctaaagtcagatgagagaccagtacata

SEQ ID NO: 3046 - DNA, 50 bp, Homo sapiens
aacagaagtcaagagaacatagaccaacttgctgcatgagtaaggtggct

SEQ ID NO: 3047 - DNA, 50 bp, Homo sapiens
agaggactatagtggaagtgaaagcattctgtgtttactctttgcattaa

SEQ ID NO: 3048 - DNA, 50 bp, Homo sapiens; identical to SEQ ID NO: 156

SEQ ID NO: 3049 - DNA, 50 bp, Homo sapiens
ccttccagaagctacgaaaaagggagctgtttaaatttaataaatctctg

SEQ ID NO: 3050 - DNA, 50 bp, Homo sapiens
ccaatggatatttctgtattactagggaggcatttacagtcctctaatgt

SEQ ID NO: 3051 - DNA, 50 bp, Homo sapiens
atctgacattattgtaactaccgtgtgatcagtaagattcctgtaagaaa

SEQ ID NO: 3052 - DNA, 50 bp, Homo sapiens
tccaatgcagtcccattctttatggcctatagtctcactcccaactaccc

SEQ ID NO: 3053 - DNA, 50 bp, Homo sapiens
tcctaggtagggtttaatccccagtaaaattgccatattgcacatgtctt

SEQ ID NO: 3054 - DNA, 50 bp, Homo sapiens
gggcattccaccgaaattcttggggaaatttagtagccttcattttagca

SEQ ID NO: 3055 - DNA, 50 bp, Homo sapiens
aaagggttttatccactgtcatttcaattggataacattttgtcaagttt

SEQ ID NO: 3056 - DNA, 50 bp, Homo sapiens
aattcctgaaccgttggatcaccttctgtcagtccatcatctccaccctg

SEQ ID NO: 3057 - DNA, 50 bp, Homo sapiens
ggcaggaggttctcactgttgtgaaggttgtagacgttgtgtaatgtgtt

SEQ ID NO: 3058 - DNA, 50 bp, Homo sapiens
gtgggtaaggggctcaagctgtgatgctgctggttttatctctagtgaaa

SEQ ID NO: 3059 - DNA, 50 bp, Homo sapiens
agacaaagagagcataaatatagctctactcatgggtaccataccagtgt

SEQ ID NO: 3060 - DNA, 50 bp, Homo sapiens
cttcaggcccaagttcaacgggttaaagaggtccgctcccaaattattct

SEQ ID NO: 3061 - DNA, 50 bp, Homo sapiens
aacaagccatgtttgccctagtccaggattgcctcacttgagacttgcta

SEQ ID NO: 3062 - DNA, 50 bp, Homo sapiens
tcttcctgggaatgtgatgtgtttttcactggttctaattctgtcttcct

SEQ ID NO: 3063 - DNA, 50 bp, Homo sapiens
tgatctgactggaaaacaatcctgtatcccctcccaaagaatcatgggct

SEQ ID NO: 3064 - DNA, 50 bp, Homo sapiens; identical to SEQ ID NO: 3061

SEQ ID NO: 3065 - DNA, 50 bp, Homo sapiens
acagcatgagaaactgttagtacgcatacctcagttcaaacctttaggga

SEQ ID NO: 3066 - DNA, 50 bp, Homo sapiens
tctctgacttcttattaccaaggacactctatctgttgcctcttactctt

SEQ ID NO: 3067 - DNA, 50 bp, Homo sapiens
gagagctttctccccgccttcagtttctgatggatctagccatgttgaaa

SEQ ID NO: 3068 - DNA, 50 bp, Homo sapiens
ggaggaatggctgtgcccgtcccctccacttaagcgacctgagtctccag

SEQ ID NO: 3069 - DNA, 50 bp, Homo sapiens
ggaaatgttgctgtgggggattcattgtaactctccttgtgaactgctca

SEQ ID NO: 3070 - DNA, 50 bp, Homo sapiens
aggtgggctggacttctacctgccctcaagggtgtgtatattgtataggg

SEQ ID NO: 3071 - DNA, 50 bp, Homo sapiens
cagacgctccagtgctgccgaggttagtgtgtttattagacctgaaatga

SEQ ID NO: 3072 - DNA, 50 bp, Homo sapiens
ccttgggctgagtttgctggtcctgaagattacagttttggttagagaga

SEQ ID NO: 3073 - DNA, 50 bp, Homo sapiens
tctcggtttacctttttgctgttgtggttctttgttcttgctggtttgct

SEQ ID NO: 3074 - DNA, 50 bp, Homo sapiens
tgtgctaagcctgatgaaatgtgctccttcaatctccatgaaaccatcgt

SEQ ID NO: 3075 - DNA, 50 bp, Homo sapiens
ttcctgtctccatgttgtggtcaagattgccatttgcttcctgagtttca

SEQ ID NO: 3076 - DNA, 50 bp, Homo sapiens
ataacagactccagctcctggtccacccggcatgtcagtcagcactctgg

SEQ ID NO: 3077 - DNA, 50 bp, Homo sapiens
gggagccatccctctctaccaaggtggcaatgatggagggaacttgcatg

SEQ ID NO: 3078 - DNA, 50 bp, Homo sapiens
ttgacctcccatttttactatttgccaatacctttttctaggaatgtgct

SEQ ID NO: 3079 - DNA, 50 bp, Homo sapiens; identical to SEQ ID NO: 2

SEQ ID NO: 3080 - DNA, 50 bp, Homo sapiens
tagttagagtccaagacatggttcctccccctttgtctgtacatcctggc

SEQ ID NO: 3081 - DNA, 50 bp, Homo sapiens
tttgcatcccgagttttgtattccaagaaaatcaaagggggccaatttgt

SEQ ID NO: 3082 - DNA, 63 bp, Homo sapiens
ggccagtgaattgtaatacgactcactatagggaggcggtttttttttttttttttttttttt

SEQ ID NO: 3083 - DNA, 463 bp, Homo sapiens
ttggcttgactcaggatttaaaaactggaacggtgaaggtgacagcagtcggttggacgagcatcccccaaagttcacaatgtggccgaggactttgattgcacattgttgttttttaatagtcattccaaatatgagatgcattgttacaggaagtcccttgccatcctaaaagcaccccacttctctctaaggagaatggcccagtcctctcccaagtccacacaggggagggatagcattgctttcgtgtaaattatgtaatgcaaaatttttttaatcttcgccttaatcttttttattttgttttattttgaatgatgagccttcgtgcccccccttcccccttttttcccccaacttgagatgtatgaaggcttttggtctccctgggagtgggtggaggcagccgggcttacctgtacactgacttgagaccagttgaataaaagtgcacacctta

SEQ ID NO: 3084 - DNA, 491 bp, Homo sapiens
gaagagtaccagaaaagtctgctagagcagtaccatctgggtctggatcaaaaacgcagaaaatatgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtcgctactg

SEQ ID NO: 3085 - DNA, 20 bp, Homo sapiens
cacaatgtggccgaggactt

SEQ ID NO: 3086 - DNA, 20 bp, Homo sapiens
tgtggccgaggactttgatt

SEQ ID NO: 3087 - DNA, 20 bp, Homo sapiens
tggcttttaggatggcaagg

SEQ ID NO: 3088 - DNA, 20 bp, Homo sapiens
gggggcttagtttgcttcct

SEQ ID NO: 3089 - DNA, 20 bp, Homo sapiens
aagtgcagcgttccttttgc

SEQ ID NO: 3090 - DNA, 20 bp, Homo sapiens
agcgttccttttgcgagaga

SEQ ID NO: 3091 - DNA, 20 bp, Homo sapiens
cgggctgttttccaaacatt

SEQ ID NO: 3092 - DNA, 20 bp, Homo sapiens
gaagggacacgcaggtggta

SEQ ID NO: 3093 - DNA, 20 bp, Homo sapiens
taccacctgcgtgtcccttc

SEQ ID NO: 3094 - DNA, 21 bp, Homo sapiens
gaggcacttgttctgctgctg

SEQ ID NO: 3095 - DNA, 20 bp, Homo sapiens
tgtggccgaggactttgatt

SEQ ID NO: 3096 - DNA, 327 bp, Homo sapiens
ggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctctcccagtgtaaatctggagccaagtccagatttacactgggagaggtgccagcaactgaataaatacctcttagctgagtgg

SEQ ID NO: 3097 - DNA, 20 bp, Homo sapiens
acgagcctgcaccaaagtct

SEQ ID NO: 3098 - DNA, 20 bp, Homo sapiens
aaacaatggcatgcctccac

SEQ ID NO: 3099 - DNA, 20 bp, Homo sapiens
tcattacagcgggggcttag

SEQ ID NO: 3100 - DNA, 20 bp, Homo sapiens
gggggcttagtttgcttcct

SEQ ID NO: 3101 - DNA, 5252 bp, Homo sapiens
ctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatatgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcttgccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagttccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctggatccatgggcatacctgtgttcgaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttggttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggaactctgtgtatgaatcctgattttaactgctaggattcagctaaatttctgagctttatgatctgtggaaatttggaatgaaatcgaattcattttgtacatacatagtatattaaaactatataatagttcatagaaatgttcagtaatgaaaaaatatatccaatcagagccatcccgaaaaaaaaaaaaaaa

SEQ ID NO: 3102 - DNA, 5252 bp, Homo sapiens
  misc_feature (3967)..(3988): n is a, c, g, t or u
ctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatatgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacnnnnnnnnnnnnnnnnnnnnnngtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcttgccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagttccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctggatccatgggcatacctgtgttcgaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttggttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggaactctgtgtatgaatcctgattttaactgctaggattcagctaaatttctgagctttatgatctgtggaaatttggaatgaaatcgaattcattttgtacatacatagtatattaaaactatataatagttcatagaaatgttcagtaatgaaaaaatatatccaatcagagccatcccgaaaaaaaaaaaaaaa

SEQ ID NO: 3103 - DNA, 841 bp, Homo sapiens
ttttttttttttttcttaaatagcatttattttctctcaaaaagcctattatgtactaacaagtgttcctctaaattagaaaggcatcactactaaaattttatacatattttttatataagagaaggaatattgggttacaatctgaatttctctttatgatttctcttaaagtatagaacagctattaaaatgactaatattgctaaaatgaaggctactaaatttccccaagaatttcggtggaatgcccaaaaatggtgttaagatatgcagaagggcccatttcaagcaaagcaatctctccaccccttcataaaagatttaagctaaaaaaaaaaaaaaaagaagaaaatccaacagctgaagacattgggctatttataaatcttctcccagtcccccagacagcctcacatgggggctgtaaacagctaactaaaatatctttgagactcttatgtccacacccactgacacaaggagagctgtaaccacagtgaaactagactttgctttcctttagcaagtatgtgcctatgatagtaaactggagtaaatgtaacagtaataaaacaaattttttttaaaaataaaaattatacctttttctccaacaaacggtaaagaccacgtgaagacatccataaaattaggcaaccagtaaagatgtggagaaccagtaaactgtcgaaattcatcacattattttcatactttaatacagcagctttaattattggagaacatcaaagtaattaggtgccgaaaaacattgttattaatgaagggaacccctgacgtttgaccttttctgtaccatctatagccctggacttga

SEQ ID NO: 3104 - DNA, 841 bp, Homo sapiens
  misc_feature (94)..(121): n is a, c, g, t or u
  misc_feature (569)..(604): n is a, c, g, t or u
ttttttttttttttcttaaatagcatttattttctctcaaaaagcctattatgtactaacaagtgttcctctaaattagaaaggcatcactacnnnnnnnnnnnnnnnnnnnnnnnnnnnngagaaggaatattgggttacaatctgaatttctctttatgatttctcttaaagtatagaacagctattaaaatgactaatattgctaaaatgaaggctactaaatttccccaagaatttcggtggaatgcccaaaaatggtgttaagatatgcagaagggcccatttcaagcaaagcaatctctccaccccttcataaaagatttaagctaaaaaaaaaaaaaaaagaagaaaatccaacagctgaagacattgggctatttataaatcttctcccagtcccccagacagcctcacatgggggctgtaaacagctaactaaaatatctttgagactcttatgtccacacccactgacacaaggagagctgtaaccacagtgaaactagactttgctttcctttagcaagtatgtgcctatgatagtaaactggagtaaatgtaacagnnnnnnnnnnnnnnnnnnnnnnnnnnnnnnnnnnnncctttttctccaacaaacggtaaagaccacgtgaagacatccataaaattaggcaaccagtaaagatgtggagaaccagtaaactgtcgaaattcatcacattattttcatactttaatacagcagctttaattattggagaacatcaaagtaattaggtgccgaaaaacattgttattaatgaagggaacccctgacgtttgaccttttctgtaccatctatagccctggacttga

SEQ ID NO: 3105 - DNA, 63 bp, Homo sapiens; identical to SEQ ID NO: 3082

SEQ ID NO: 3106 - DNA, 609 bp, Homo sapiens
  misc_feature (303)..(304): n is a, c, g, t or u
acatcagtggctacatgtgagctcagacctgggtctgctgctgtctgtcttcccaatatccatgaccttgactgatgcaggtgtctagggatacaggtcacacagccgtccatccccgtcctgctggagcccagagcacggaagcctggccctccgaggagacagaagggagtgtcggacaccatgacgagagcttggcagaataaataacttctttaaacaattttacggcatgaagaaatctggaccagtttattaaatgggatttctgccacaaaccttggaagaatcacatcatcttanncccaagtgaaaactgtgttgcgtaacaaagaacatgactgcgctccacacatacatcattgcccggcgaggcgggacacaagtcaacgacggaacacttgagacaggcctacaactgtgcacgggtcagaagcaagtttaagccatacttgctgcagtgagactacatttctgtctatagaagatacctgacttgatctgtttttcagctccagttcccagatgtgcgtgttgtggtccccaagtatcaccttccaatttctgggagcagtgctctggccggatccttgccgcgcggataaaaac

SEQ ID NO: 3107 - DNA, 50 bp, Homo sapiens
gaaattggaaggtgatacttggggaccacaacacgcacatctgggaactg

SEQ ID NO: 3108 - DNA, 738 bp, Homo sapiens
aaagcagaattgagagtttgttcttacacacaagtttaatgccaccttcctctgtctgccatggaccaacaagcaatatatgctgagttaaacttacccacagactcaggcccagaaagttcttcaccttcatctcttcctcgggatgtctgtcagggttcaccttggcatcaatttgccctgaaacttagctgtgctgggattattctccttgtcttggttgttactgggttgagtgtttcagtgacatccttaatacagaaatcatcaatagaaaaatgcagtgtggacattcaacagagcaggaataaaacaacagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattgatacacacacagaacctgatacgtgacaaagcaattctgttttggattggattaaatttttcattatcagaaaagaactggaagtggataaacggctcttttttaaattctaatgacttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactcttga

SEQ ID NO: 3109 - DNA, 3809 bp, Homo sapiens
gccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacggtcccaggcccagagaagatgagtctatggcatcaggttcttaaaccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagcgcagctcagctgcactgcgttccgaggtgaagtcttgcccctgaattttgcaaaatgggaaagtgggcgcttgccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgta

SEQ ID NO: 3110 - DNA, 1161 bp, Homo sapiens
caaagagctacatgccacatgctgttctccagcctgctgtgtgtatttgtggccttcagctactctggatcaagtgtggcccagaaggttactcaagcccagtcatcagtatccatgccagtgaggaaagcagtcaccctgaactgcctgtatgaaacaagttggtggtcatattatattttttggtacaagcaacttcccagcaaagagatgattttccttattcgccagggttctgatgaacagaatgcaaaaagtggtcgctattctgtcaacttcaagaaagcagcgaaatccgtcgccttaaccatttcagccttacagctagaagattcagcaaagtacttttgtgctcttgggacgggggtgaggggactccaggacaccgataaactcatctttggaaaaggaacccgtgtgactgtggaaccaagaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttgtaaggctgactggcatgaggaagctacactcctgaagaaaccaaaggcttacaaaaatgcatctccttggcttctgacttctttgtgattcaagttgacctgtcatagccttgttaaaatggctgctagccaaaccactttttcttcaaagacaacaaacccagctcatcctccagcttgatgggaagacaaaagtcctggggaaggggggtttatgtcctaactgctttgtatgctgttttataaagggatagaaggatataaaaa

SEQ ID NO: 3111 - DNA, 611 bp, Homo sapiens
  misc_feature (543)..(543): n is a, c, g, t or u
ttttttatgggtttccttaaatgtttttatggttaaaatctgtacaaacagatatatttatataagttacatattttaagaaaaatcagtcatttttcatatataattgcaaagaattaagatcatttaactttagcactataagcaagcattaaattaaatgcactcagatttttggcacattatatggcattccttataccacatatttataagatctaaaggattataaacatattacacataataattaagtccaatataaattgtgttcaggttataaaatgccctatttaagttgtgctcttggtgagggtgaacagaaaagaaaaggcttcttctttagcccttaagcctatgacacaatttccatgctggtaattcctttcatcttctgaagaatctctattttattataacattattggctttcagcttggaatttctctacgcagattgtctattgacagtgccaaggaaacatctcactgtccacagaatagcagcctccacccagttgaaagctgcacattgtttccactntaccattggtacttccctctgatggcatccagcacacgaccattagcctgagtgatgcccaactgagc

SEQ ID NO: 3112 - DNA, 572 bp, Homo sapiens
ttttggggacttcttagcttgctctctcctgagtcccactggccaccccagcacacagcagaggcctagcaagtctcaagtgaggcaatcctggactagggcaaacatggcttgttccaaaagccgggggttaaggaatcaaagtcaggtgaaactatcactttcacaaaagcttttcttgactcctgggcctagtatcttttgcccctggcagaatgtaacagcaaaatgtctccttctgaaacggaaggcacagccctctttcagaagcaaaacaccttaacactcggcttctatttgcttaagaatttacaaatagaaatgagaatcaaaggttttaactcatctgatagcactgggcacccaatgttcacagcctgcttctttgaattgttagtgtctccccaataaataaatacagaaccttggatacccttcgaattttaaaataccttaaagtcttccattaatcttattttttaaaaatgctaggtttgtttcagttacctgcagcaatcaaaaagctttggcaccttcttttagagaattgcacaaaacaggatgcatcaagg

SEQ ID NO: 3113 - DNA, 1026 bp, Homo sapiens
cagcatgttgagccgggcagtgtgcggcaccagcaggcagctgcctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaactggactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctag

SEQ ID NO: 3114 - DNA, 1271 bp, Homo sapiens
ctgtattgtggttcctggaacactttagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatataatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaa

SEQ ID NO: 3115 - DNA, 358 bp, Homo sapiens
gggtttatcccaggatattcattgatagaaaattaaaggagtaatttataaaatcactacatgaacaagtaaaaacacacacagcaaaatttacatcaaaattattacgtggtacagaatccaaaagtcataaaaagcaaaagctatctttttttcactctggcacccatctgttcttccctggagtcaaacactattaccaatttttaggtatacttccaaagatacttactgcatttacaagcacagacttatattgattctaaaagaataagagacattttcagcatgttgctttgttcaacaccacagtatatcttaaagatggtcccccatcaatacatatagagatctctct

SEQ ID NO: 3116 - DNA, 4045 bp, Homo sapiens
gcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccgtccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcctgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttatttaaagaaaaatctttgttactctgtaaatgaaaaaacccattttcgctataaataaaaggtaactgtacaaaataagtacaatgcaacaaaa

SEQ ID NO: 3117 - DNA, 573 bp, Homo sapiens
  misc_feature (521)..(521): n is a, c, g, t or u
gattgtataaataatttatttctgttcacagcatcatatatgcattataaaaggctatggaaacaaaagagaaggatgatgagacagagaattacagcagtagaaaggaaaacagaaaccagggcacacagttccaacaccagaacagagaatttgggaagataattgctctgaaacagaactggcctccctgtgtctattagaaaacatttccaaagctcacggagggaggccaacttcccctatgggaaacccattcactcgccaaagggcagaaggcatcataaatcacccattgatacattggtggggggctcctgtccccctggtgaccactccaaggtgatttgatctgtgcttcctctgttgggtcagagacgaaacgggctattattaggtcaaacattacagaaatcaactgagactcttaactagtagttgatacaccacagggctttactttactgcacaattactaacagttgattgcacccttaagtattgattatgcaaaaaacaanatcatctcgcatcagttttaaagcatgacagggtttgaacagtgatcttgaa

We claim:

1. A method of assessing the immune status of an individual comprising detecting the expression level of one or more genes expressed at different levels depending upon the rate of hematopoiesis or the distribution of hematopoietic cells along their maturation pathway in said individual, wherein said one or more genes comprise the nucleotide sequence of SEQ ID NO: 52.

2. The method of claim 1 wherein said expression level is detected by measuring the RNA level expressed by said one or more genes.

3. The method of claim 2, further including isolating RNA from said patient prior to detecting said RNA level expressed by said one or more genes.

4. The method of claim 2 wherein said RNA level is detected by PCR.

5. The method of claim 2 wherein said RNA level is detected by hybridization.

6. The method of claim 2 wherein said RNA level is detected by hybridization to an oligonucleotide.

7. The method of claim 6 wherein said oligonucleotide comprises DNA, RNA, cDNA, PNA, genomic DNA, or synthetic oligonucleotides.

* * * * *